United States Patent 12,642,819 (COMPOSITIONS AND METHODS FOR TREATING INFLAMMATORY BOWEL DISEASE) - sequence listing, part 14

SEQ ID NO: 6 - DNA, 5826843 bp, Bacteroides fragilis (residues 3,884,563-5,826,843 of 5,826,843)
  modified_base (56910)..(57006): a, c, t, g, unknown or other
  modified_base (160801)..(160898): a, c, t, g, unknown or other
  modified_base (872374)..(872473): a, c, t, g, unknown or other
  modified_base (1766174)..(1766269): a, c, t, g, unknown or other
  modified_base (1943836)..(1943934): a, c, t, g, unknown or other
  modified_base (2187934)..(2188032): a, c, t, g, unknown or other
  modified_base (2295704)..(2295799): a, c, t, g, unknown or other
  modified_base (2778584)..(2778677): a, c, t, g, unknown or other
  modified_base (3788221)..(3788373): a, c, t, g, unknown or other
  modified_base (3980870)..(3980965): a, c, t, g, unknown or other
  modified_base (4123705)..(4123801): a, c, t, g, unknown or other
  modified_base (4273557)..(4273655): a, c, t, g, unknown or other
  modified_base (4676140)..(4676236): a, c, t, g, unknown or other
  modified_base (5657830)..(5658726): a, c, t, g, unknown or other
  modified_base (5717834)..(5717964): a, c, t, g, unknown or other
  modified_base (5718950)..(5718959): a, c, t, g, unknown or other
  modified_base (5753025)..(5753804): a, c, t, g, unknown or other
  modified_base (5759611)..(5759717): a, c, t, g, unknown or other
  modified_base (5765062)..(5765071): a, c, t, g, unknown or other
  modified_base (5792087)..(5792096): a, c, t, g, unknown or other
gcatttcattcactatcgtcgtatccacttccatgtcatgataactcagattgaaacggtcggtctcttccaatatatattcgtgggtatagtgagccatgtctttgtaaagccggacgctgaacaaggtatattctccgggctggctctctacacgaatttcaccgtcatgcaaatcgacgtattctttcgaaagattaagtccgatgccgaaacctgccgtaccgaatgttttattaccggtataaaaccgctcgaagagatgctccatgctctcttttgaaatcccccgcccgtggtcctccacttccaccagaacagtttctgcctcaccgataaccctgacggaaatatccccgccgccatccgaatatttaaaagcattcgaaatgatattcaccaatacctgctctatcttattgacatcgatatggatattcagctcgtcgatgttggtgcggaactgataatgaatctgcttctcctgagcaataccggtaaagtagtcgaagacttctctgaccattcctatcagatctacctgacgcagaatcagtttcatcttgtcgttgtcaatcctgcgaaaatcgagtatctggttgacaatccggtagagccggtctacgttccgcttcatcaaagccacatcttcctgaatagaaggatcgagcctggagtttttaatcagtttgtttaccggccccagtattaacgtaaggggagtacggatttcgtgggagatattggtaaagaactgcaatttctggttcgagatgttttctatctggttattcttgaccgccagttcctccttctgcgcctctacaagctggtttttatcatacagttctttgtttttgttcttgatacggagattcatgtacatgacatatcccaacaaagggataatgagtaacatcaacgccaggatcagtatggtggagttgcgcaggaacttgaaacgagacagcagattgtcttcttcctgcttctggcggttgatccgcttctggtaatgattcagttgttcggactgtgccagaatggtttttgcgtttccccggttaatgatagcggtattcaatacgtagtttttcttcaccttctcgccattaataatggccatagccacctgaatggagatagctcctccggtaggatactgaaaagaggcttccaatttctcgtcggctacagcctgcaatccggctccatcaccatatactccgtcgatacctataaaccggatacgtctgccggacacggagtcacgcttcataatgacatcacgtgcagcaagagccatcacatcattatgggcatacaccaagtcgatatctgtaaaagcaggcagcttgctgacagcatcgtaagcactgttatagtgccacttaccaaaaacctgggtcacccggaagtttttgtcgctgcggagatggtcaataaacccgtcatggcgttccatggcgggcgaagaaccttccagtccccatatttcaagtatttgggaattgggagaaagttgtccgttgatatattcgccgatggcagaaccgatgttgtaattattggcgccgatagaaaccgtatattcatccgactgtatcttacggtcgtggataatggtaggaatgcctttccggtaggcttccactgccacgtcggtaatgggaacagcttcgttgggtgaaatgataagtacatccacattctgcgaaatcagtttacggatctgggctacctgccgactgctgttatccattgcattatatactaccaactccacgttgcggtaattggaggcttcaatctgcatttcgagcaatacggcttcgcgccaggaatcggaagtgcactgagaaaaaccgataacatattttctgtccgcctcttccttccgttggcaagaagacaggaatacgaacaggcctgcaaaaagcaaaatgccgaaccgaaatagatttgtgtttttcatgctgtgttctccttagtaatacgtatataagacgtcctgaagcaaagaaacaggacgccttatcaaaagaaaatgttcgttaccagatggattttaccgagaacacttccaagttcttgacttctatgttgttgccccagaagtgaagtccttcgcgatttccttcacgcgggctccgtttcatcgaatacgaataagctcctccgtcgatgaagacttcgatagaggtacggtcgatgtatatgtcggctgtcagttccatactggtgcggtcgtcgggtgaatagaacacaccgtttatcagattggagttcatgtcataatccaccagaggctgtccgtaaagattcagtccggcactggttgcatgtgataacttgatggtagtccgtatccgcaaacagtccttatcggaaaatgattgtaaccgcccgttggctgcatcagaagtaagtgatgtccagtttcctaccggccggaacagttgctctgcctccctgacaggaacactaaacaaacggactccctttgaagtagtacgaagggtcagttcattgggcagcagcatcattccgttgaacggcatgccatcgtgtgaaattcgtccccagcctatctggatgcgacgtccgtcactggcaggcaggttgctataggtttgggcagcatacatacttcctgtataatagtagtacttacccgcctccggagtaaatgtctggccatcaaacgatcccagcatataagtacccgaggctccgtacatcacccatttcgtgtgattcttatctccgtcgaccggcagctcaaacagttcgggacattcccagaaaccggtaacatggctcttgtactcccagttcttcaggtcggaagagttgtagatggaatgtccgtcccgctcgttgagcaccatcacccaatgtttgccgggtgcgtaccagaaaactttcggatcacgtgtgtctttactattccattttgcctttgagtctatcaccggattgccttcgtatttggtaaacgtacgtccccggtcgagactgtaggcaatgcactgtcgctgtttctccggattatccactgtataggcggctaccagtgccggctctccttttttattaaatccggcggtattatcataatcgatcacggccgaaccggagaagatggttcccagttcatcggggtgcaaagcatccggcagttcctcccaatgtaccaggtcacggctcacggcatgtccccaggtcatgttctcccattcccgttcgtaaggattatgctgatagaaaagatggtattcaccttcatagtaaaccaatccgttaggatcgttaatccatccgcgacgggtagtgaagtgaaattgcggacggttcttctctttatacaggctgtcttgccccgcaatcacatcgtcctgatagatcttctccaatccggcagactctccttcatagctgattcggagtgtcttgcctttccaggaagaaacatcgcaaaatacccaataatcgggtttcccgtcggccaggcgaatcacgaaattacgttccggagcccctttcacctcgaatgtcattttcttccggtccatttggtgggacacgggcaggttgatatacttcttcgtaatcttcagcgtaacatcgccggcaaatgaagcaaacaggttaccggcaagcagcgttgcggcaagaaataattttgtagtcaaatgcatagttttattttgttagttaataatggaaaacctgagtgcaattttacgcattttttcagggataagctatcactcagcgtacaaaacgtatcactcaagttacccgaaagaagctttacggtcatacagatgtaacatctttgtcacccagcgttcaaacaactgtaaaagtgacgaaacttcctccctctacttttgcaacaaattattaacgcatactaacaaatatgaaacgaattctgaaactggtatcattcgttcttttattatcgaacatgggcggtcatctctacgccgatgaaaaagcaaacgtagtaaaacaaggtacgatccggggacgtatcatcgacacatccaaacagacattaccgggggcatcgatctacatcgagaacctgaaaacaggagtaacgagcgacgtaaacggtttttataccttcgccaatctcaatccgggaacttacaccgtaaaagtaagctatgtgggatatgctcccgtagaaatgaaaataacgattcccgaaggcaagacgctcgaaagagatgtcatactgaatgaaggggtcgaattgcaggaaattgtaataggcggtgcttttcaaggccagcgccgcgccatcaactcacaaaagaacagtctgggcatcaagaatgtggtttctgccgatcaggtaggtaagtttccggactcaaacatcggagatgcgctgaagcgcatctcgggtatcaacgttcaatatgaccagggtgaagcccgtttcggacaggtgcgcggtacatcggcagacctcagttctgtcacgatcaacggtaaccgcatcccatcggcagaaggtgatacacgtaacgtgcagcttgacctgattccggcggatatgattcagaccatcgaagtgagcaaagtggtaacctcggacatggacggcgacgccatcggaggatcaatcaatctggtcaccaagaactctccttataaacgtacgctgacagccacagccggttccggctacaactggatcagcgaaaaggcacagctgaacctgggattgacttatggcgaccgcttctttaatgataaactgggggtcatgctatcggcttcgtatcaaaatgccccttcgggttcgtacgatacggaattcctctggaagaaagacgataaaggcaatgtatacatcaatgactatcagatacgccagtattatgtgacccgcgaacgccagagctattcggcagccctggattgggacatcaacgaaaaccataaactgatgttcaaaggtattttcaataaccggaacgactgggaaaaccggtaccgcactactcttaaagatctggacgaagaaggcaaagcaaccgtacgcgtacagactaaagccggcacacccgacaatcggaatgcccgtctggaacgccagcgcacaatggacttcacattgggcggggagcatctgttcggaccgctatctatggactggaacgccagttatgcccaagcaaccgaggagcgtccaaacgagcgttacatcgactttcagctcaaaaagcagcaattcgatatggatctgagtaacgaacgcgaaccattggctactccgaagcccggctctacgatgacgctgaacaaggatttcggcctgaaagaacttaccgaacaacaacaagacatcaaagaagaagatctgaaattctctatgaacttcaagcttccgttccaaaacggaaacaaactgaagtttggagccaaagtagtgcgcaaaaccaaagacaaggaggtggatttctatgaatataccccgaaagatgaagatgcatttatgacccacagcctgcaaaatacggtagatcagactaacaaaaacttcatgccgagtaacaaatacaaggcaggtgtttatgccagcaaagaatatgcaggctcactggatctgaacaatccttccttatttgacaaagaacaggtacaggaagaactggcgggcaacttcgaagcacgcgagactgtaagctcgggatacatccgcttcgaccagaaactcaccgacaacgtggagctgatgacaggactacgcattgagaataccagcctcagctataccggacggacgtatgacgacgaaacagaccaaacctcaaagactgcccgagaaacaaacagctacatcaacttccttccgtcactccttatgaagtggagcataaatgaagaattcaaggtacgcggttcgtttacccagacgctgtcgcgcccgaagtattccgccctggtgcccagcgtcaacattaaacgttcggataacgaagtgacagtgggtaatcccggcttgaaaccgactctttcttataacttcgacctgagcgcggattattacttcaagagtatcggcctggtcagcgcaggagtattctacaagaagatagacgacttcattgtcaaccaggtggctacgaactacgaatacaacggcaacctatacaaccgctttatccaacccaagaatgcaggcaatgccaatctgataggtatggaactctcttaccagcgtgatttcggatttatcgctcctgccctgaaatgtgtcggcttctatggcacgtatactttcacccactcccgtgtagaagacttcaacttcgaaggacgcgagaacgaaaaggacctgagcctgccgggctctccgaagcataccgccaacgcatcactttattttgagaaaagcgggctgaatctccgcctgagttataactttgcctccgcctttattgacgagatgggtgaagacgcctttcacgaccgctattatgaccgtgtgagctatctggacgtaaatgccagttacacttttgcaaaacactacaccctctatgccgaagcaaacaacctgctgaatcagccgctccgctattatcaggggacaaaagaccgcacgatgcaggcggaatattatggcgtaaagattaatgccgggtttaagatcaacttctaaccggcaccgccggaggatgttaaaccaacggtacaccaccggcgagaagacacatccgattcatcaataatcaatataaaaaaaacatatttatgaaattaaagaacttactgacacttctatttatcttcatcggggcgatagcctcagcccagatcagggactactctatattcgacaagaagtttaacttctatattgccaacgatctgggacgtaacggctactacgaccagaaaccaatcgccgaattaatgggaactatgggcgaggaaataggccctgaatttgtactggctcccggagacgtccatcacttcgaaggagtacgcagcgtggacgacccgctttggatgaccaactttgagctgatctacagtcatccggagctgatgatcgactggtatcccgtgttgggaaaccacgaataccggggtaatacacaggctgtactggactacagccgggtgagccgccgctggaccatgcctgcacgttattacaccaaaacgtttgaagaaaaaggtgccaccatccgcattgtctggatagataccgctcccctgatcgacaaataccgcaacgaaaccgaaacttatcccgatgcctgccggcaggatatgaacggacaactggcttggctggattctgtgctgactgctgccaaagaggactgggtaatcgttgccggccatcatcctatctatgccgaaacaccgaaagaccagagtgaacgcggtgatttgcaaaaacggctcgaccctatcctgaggaagcataaggtagatatgtacatctgcggacacattcacaacttccagcatatccgtgtaccgggcagtgataccgactatatcgtaaactctgccggatcgctggcgcgtaaggtgaaaccggttgaaggtactcaattctgtagtcccgaaccgggattttctgtatgttctgccgataaaaaggaattgaacttacgtatgatcgataaaaaagggaatatactctatacagtgacccgaaagaaataaatcactctctcttgaaaaatacacaactttcaaagagccggcttcttcgcgacgaaagagccggctctgttttatgggacacaggagccaattacgcaaactgacactgagttttaatctttaggaatatataagatagaatcagtctctatatcctctatagtaaatcagaacctgaaagctctgtggtactcctgcttcttcactctgcaatgaatcggagaaccgactctctgagaggctctacttgttaatattcaaaaacaaatcaacaaccgataaaatgtattctataattaccaaaatcgatttaagggcgtttaccctccgaaaaattgagatcacgacgacgattttttgtcatcgagacgatgttttgttgagatcgtgacgacgctatatcgccctctggacgacgattttcaattttcctgattttgtataaaaagaaaaccgctactgatagcggtttctaatggtattatgtcttgatttttacttatcttgatttctgcttttttttagaggatctatccagatactgaccaagcaggcgggattcttctttttaatctccgtaaagataggaacaatcgtttgagaaagcaaaaaaacagggcgaaaacttatttcttacgataaaagacatagagtgtgccataaagtatttattcttaattaaccggaaacttaaccgtttaagatcctccgtggtgtgagtttttgactcatccgcttactactgtttatcggttttaggtctcagatcatctttcggaatggtagactcgttgccgtcacgcatagccatatagtgaggtgacatgatttcgacgctcgcttcattaaaacgatcctgaatgttctgatgcagatccgaataaatttgcgccaacttatccgcctcgcgaatataagcattgatctgataaaccgggtaccagtcgcttaatgacgtttcaagtacaaacggacgaggatcatcaatcactccgggagtattcaaggcggcttctatcagcaactggtgcacctgacgccagggagcatcgtaaccgatggtcacctctgagtgaataatcaatccgtattcgcgcgccgaagagctatagttcaccgtatgggacgacatgataaacgagttggggattgtcaccacttcattcttcggtgtcctgatcctggtcaccaaaggtgttttctctatcacgttcccggtagtatcattcagctggatgcggtcccctaacttgaaaggacgcatataggtaatgacgagtcccgcaatgatattaccgatcaccgtactggaccccaacgaaacgatcaatccaacgaagaccgatattccctgaaacaccccgcttctggatcccggcaaataaggatagatcatcgcaatcataaatgcataaagcaaaaagcggataatatggaaagtaggcattgcccagtcgggataaaaaccgccgaacttaagccgcccggcttcaatctcacgggacagatagtggacaaaacgcaccagatatttaatagcataccagataataaagatggtgaacagattgggaatataatcgacgatgcctaccaaaatatccttcaccggattccagatatacgaaaagatcgtgtcggccaaccccttggtctgcggaaaaataacaaatagaagcggaacagtaatcaacaactggagaaacaccagcacgtaacgcaacaggttggaaaggaagatcagcaaattaacctgccgttgtgtgtccagcagttcatagtcctgaatggaaatgggtttcaactttgtgtccttcagcttctggatacgtactttcagcttacggaaaagccaggtagtaagccggaacaagagatattgccccaccaatactaaaacgaaatagagaatccgtttacccaattgccagaagctgtgttcctctttcagttccttcagcttcttcactaccacgatacgcttatctgccgccagttgctcacgggaacgtccttcccacaacccgtcctggtcggtaaacgaagcaatgaccttattgccatacatcaaatcggacactatatcactgctctctatatataccgaatcgggatgcagcgtaaaccgtttacccaattgggtaatggccgcgtcaatcatttcagccctctgcaacggagtgtatcctccacgcttggtgtagagataaaacaacgtatcaccctcaaccaccaccggtacgcccggagtgaactgacggagcgagtcgatgcgtgctttctgctgtgccagcttcacagaatcggcagcaaaggccttcaacctcaactgctccatttccatacgcatattggcttcattcagacgtgcctcttccaactcccttttcatatttgccatccgtatggaatccgaatcattccggaccgtggtatgggtaacggtactgtcgccggtcagtatctcccggaccgctttccctaactgggcaaacatactgttggccactaacagaaacaacaaaaggctgaataatctgttcttcttcatatcaaaaactcatatagtcattgtcactaaaatggataaacgtgccaaacatacagattgtttttgacatagcatagagtgaaatcactatatttgcacccgaatcagtaatttaaggtatcaacatggatatattactacttatcggaggattactccttattttagtgggcgccaactgcctgacggatggagctgcgtccgtagccaaacgtttccatattccttccattgtgatcggactgaccattgtagctttcgggacatcggcaccggaactgacggtaagtgtatcatccgccttgaaaggcagtgcggacatcgctgtcggcaacgttgtgggaagcaacattttcaataccctgatgatcgtgggttgcacagccctcttcgctcccattgtaatcacccggaacaccttgagaaaagaaattcccttgtctattctttcttccattgttctgctgatatgtgccaacgatgtctttctggacaaagctccccgtaatacattaagtatttcagacggattgattctgctctgcttcttcactatctttctgggctacacatttgccatagcttctcgtaatacgaacgacgcccagccaccggaagaagaaatcaaaagcctcccgatgtggaaatccgtactttttattctgggcggattaggcggacttatcttcggaggacagtggtttgtagaaggagcaagtaacatcgcccgtaatctgggtgtcagcgaatccgttatcggactcacactcgtagccggaggcacctccctgcccgaactggctacctccattgtggctgccttgaaaaagaatcccgaaatagccatcggcaacgtcataggcagcaatctgttcaatatcttctttgtgttggggtgcagtgcctccatcacccccttacagttggcaggcatcaataatttcgatcttttcacgttggtcggatcaggcatcctgctctggtttttcggattattcttcgccaaacgcaccatcacacggatcgaaggaagcattctggtcttgtgctatatagcctatacaacctatcttatctatcagatctgaaaacattgaggcacacagtttttagtttctgtacgtggtaatttaaagattatcacgtatctttgctgcctcatcataaatacaagttatggccattacaattaaaaaggtatcgacgaaaagagaacttaagaaattcattcgttttaattacgaattatacaaagagaatccctattccgtacctgacctctacgacgacatgctgaacacattcaataagaagaaaaacgcggctttcgaattttgtgaagccgaatactttctggcttataaagacgggaaaatcgtagggcgcatcgcaggtatcatcaaccaccgtgccaatgccacctggaacaagaaagatgtccgtttcggctggatcgatttcatcgacgaccttgaagtatcttcgaaactcttgcaaaccgtagaagaatggggcaagtccaaaggaatggaaaatattcagggtcccctcggatttaccgactttgacgcagaaggcatgctgatcgaaggattcgaccaactcagcaccatggccactatctataactatccctactatccgcaacatatggagaaactgggattcggcaaagacgccgattgggtggaatataaaatcttcattcccgatgccattcccgaaaaacatcagcgcatatccgatcttatccaacgtaaatataacctcaaggtaaagaaatacacttcatccagaaagatcgcagccgattacggacaagccatcttcgaattgatgaacgaagcttacagcccgctgtatggctactctcccctctcccaacgccagattgaccaatacgtaaaaatgtatctcccgattgtcgacctgcggatggtgaccctgattaccgatgcggaagacaaactgatcgccgtaggaatttcaatgccttcactttcagaagcattgcagaaatcacacggacgattactccccctcggatggtattatctgctgaaggcattatttatgaaacgacgggccaaaatgcttgacttgctgcttgtagccgtaaaaccggagtaccagaacaaaggtgttaatgctttgttattttccgatttaattccggtttatcaaaaattaggttttatctttgcagaaagcaaccccgaactggaaatgaacggaaaagttcaggcacaatgggaatactttaaaaccgaacaacataaacgacgtcgtgcgtttactaagaagatagactaaaaacaatggaagagaacgaactgatacctgtagacaacaaccctgtagaatatacagacgacaacatccgccacctgagcgacatggaacatgtgcgcacccgtccgggtatgtacatcggtaagctgggcgacggttcgcatcccgaagacggaatttatgtccttctgaaagaagttattgacaacagtatcgacgagttcaaaatgcaatccggcaagaagattgaaatcagaattgaagagaatcttcgtgtcagcgtacgcgactacggccgtggtatcccacagggaaaactggtagaagcagtcagtgtgctgaacaccggtggtaagtatgacagcaaagcattcaagaagagtgtcggactgaacggtgtcggcgtgaaagctgtcaatgccttgagctcaaacttcgaagtacgtagttaccgggatggtaaagtgcgttgcgccacctttaccaaaggtgagttgataacagatcacaccgaggataccgaggaagaaaacggtacttacatcttcttcgaacccgataatactttatttctgaattatactttccgtcccgaatttatcgagacgatgctgcgcaattatacctacctgaacaccgggttggccattatctataacgggcagcggattctttcgcgtaacggtctggtcgatttgctgaatgataatatgacagctaccggactctaccccatcgtccacctcaagggagaggatatcgaaatcgcttttacccatacaggacaatatggcgaagagtactattcattcgtcaatggacagcacaccactcagggaggtacccatcaaagtgcgttcaaagaacacattgcccgcactatcaaggaattctataataagaaccaggactataccgacatccgtaacggattggtagccgccattgctgtcaatgtggaagaacccatgttcgagagccagactaaaattaaactcggctctaccaacatgtcgccgggtggcgttactgtgaacaagttcgttggcgactttgtaaaacaagaggtagacaatttcctccacaagcatgcagatgtagccgaaatcatgttacagaagatacaggattcggaaaaagaacgcaaggccattgccggagttacgaaactggcacgtgaacgtgcaaagaaagccaatctgcacaaccggaaactgcgtgattgccgtatccacctgaacgatgtgaaaggcaaaggcctggaagaggaatcgtgcatcttcatcaccgagggtgactcggcaagcggttccatcaccaaaagccgggatgtaaacacacaagctgtattcagcctccgtggtaaaccactcaattctttcggcctgaccaagaaagtggtttacgaaaacgaagaattcaatctgctgcaagccgcattgaacatagaagacggcatagagggattgcgttataataaagtgattgtagcgaccgatgccgatgtggacggtatgcacatccgcttgctgctgatcactttcttcctccagttcttccccgatctgatcaagaaaggacatgtatacatccttcagactcctcttttccgcgtacgcaacaaaaagaaaacactctattgctataccgaagaagagcgggtgaatgccatcaaagaacttagcccaaatccggaaatcacccggtttaaaggtctgggagaaatctcgcccgacgaattcaaacactttatcggtaaagacatgcgtcttgaacaagtgtcgttgcgcaaaacagacacggtcaaagaactccttgaattctatatgggtaagaatacaatggaacggcaaaactttattattgacaatctggttatagaagaagacatcgcatagacatgagaagagccatctttccgggaacgttcgacccgtttactatcggacactattctgttgtacaacgaactctgacatttatggatgaagttgtcatcggtatcggtatcaacgaaaataaaaatacgtacttcccgatagagaaacgtgtggaaatgattcgtaagttttataaagacgaaccccggatcagggttgaatcttacgattgcctgactattgattttgcccgtcaggtagatgcccgatttatcgtccgtggcatccgtaccgtgaaagatttcgaatacgaagaaaccattgccgatatcaaccggaaactggcaggaatcgaaaccattctactgtttaccgaaccggaattgacctgcgtcagttctactatcgttcgcgaactgctgggctataataaagatatcagtatgttcattcccaaagggatggaaatgtaataaccccatgtgatcatgaaaaaaataatatacctgtttatcggtttgtgctctgtcttaggattacaggcacaaaacttcggctcgcccgccatgcggaaattgcaattagcagagttcgctatctctaatttatatgtagatacggtcaatgaaaacaaactcgttgaatcggcaattattgagatgctggcacagctcgacccccattccacctattcggatgccgaagaggtgaagaaaatgaatgaaccgctccaaggcaatttcgaagggataggtgtacagtttcagatgatcgaagatacgctgctcatcgtacaaccggtgagtaatggcccgtccgaaaaagtgggtattctggcaggagaccgcatcatcgcagtaaatgacacagccatagcaggcgtaaaaatgggaacagaagaaatcatgggacgcctgcggggccccaaagactcaaaagtaaatctgaccattatccggagaggtgtgaaagaaccacttttatttaatgtaaaacgagataaaattccaatcctcagcctggatgccacttatatgattcagcctaaaataggatacatccgtatcaaccgttttggagcaactaccgccgaagagtttctaaaagccctgaaagagttgcagaagaaagggatgaaagacctgattctggacctgcaaggcaacggaggaggttatctgaatgccgccatcgatctggcaaacgagttcctgggacaaaaagaactgattgtctacacagaaggacgttctgcacaacgcagtgagttttttgccaaaggcaatggaaacttccgtaacggacgtctggtggtattggtagacgaatattcggcttcggcaagtgagattgtgacaggtgccattcaggattgggacagaggagtagtggtaggccgccgttcgttcggtaaaggactggttcaacgcccgatcgaccttccggacggttctatgatccgcctgaccatcgcccgctactatacacctgcaggacgttgcatacaaaagccttatgacagtagtatcaacgaaaaatcgggaaaaggaaaaagcagtgaaaacagcattgaaaaatacaaccaggatctgatcgaccggtataatcatggcgaaatggtcagtgcagacagcatccacttcccagactcactgaaatgccagactaaaaaactgggacgtacggtttatggtggaggaggtatcatgccggactacttcgttccggtagacacaacgctatataccgactatcaccgtaacctggtagccaaaggggtagtcattaaaaccacaatgaacttcatcgaaaagaaccgaaaggctttattggataaatataagacattcgagaaattcaatgaaaagtttgaaatcgacgaccagctattgaactacctgagagaagctgccgataaagaaaagattgaattcaacgaagagcaatacaacaaagccctgccactgattaaagctcagctgaaagctttgatagcccgtgacttatgggatatgaatgaatatttccaggtaatgaatgctaccaataagagtgtagaacgggcattggaaatcttaaacgacaaggagtacgaacaaatattgaaataacgtttctataacggaaaacgatataagggtgtattatcattcaccacagagtaacatagagtaaacttaatctactgataatgacaactaatgatattaatctgtggtactctgtggtgaatatgagtttcgacacacactgcttattgtcaataatttattgtagccttcttcttctcaccgaacaaccacttgttaagccatctattgacataaatattggccactgcacaaccagctcctatcacagctcctgccgctacatccgacgggtaatgtactccttcgttcattcttgagaaccctacagaacatgcccaaaaagcggatggagctatcacgtaccatttaggatagcggatgctcaaagaagtagccaatgaaaaggccgccgccgcatgaccggaaggaaacgaaggactcgattcatggctgcgcgcattcacccgatccggataacggtcatatggccgctcacggtcaaaagcatatttcataccatatgtaattacaactgcctcggctacactcgttccaatataaatagcatccttcaataactctttatctttatcaatccctgcatatacagccatcgccaccggaacacctactgcgatataaggtgccgatttagaaaaagccttgctataattcctcgcaaacttaccatcaagactgtttattttatgtaacgtattgatatcccagttctgagcataccctcccatcgaagaaagcacacaaaaacaaataagcacaaatttcttcatttttctactaatttactattttgcagcaaagatagattaaaaagacagagttttcgcaaaaaaaacctatctttgttccccaagtattatttaccctgacacctaactttaattcatggccagagaaactctttgtaatagacagacagattgtgcgcaatgtcccaaagctacagaaggcatacttgttcatcggacgtttccaaaaggacaacatttcccggctgacaaatgcacacaaaactgtattctgtttatgctacaaggagagttattgatcaacagcgaagagtatcccggcacaacgttacgcgaaggacagtttatcctccagtccatcggttcaaaattagaattattggcgctgacagacgtaagttatgtagtgtattggttcaacgaaccacctttgatctgtgagcaacattatcaggaaatcctgcaacaatcagaatcacccttaacttatacgcctttggtaatgacccaacgtattaccaatttcatgaaagatatttgtgattacctgagtgaacagattccttgcggtgcgtttatcgatctcaaatgtcaggaacttatgtatctgattacctgctattacccgtcaccccaattaagtagattcttttatcccatcagcagttacacagaaagtttccaatatttcgtcatgcaaaattacgaaaaagtgaaaaacgtggaagagttcgcacacttgggaggctatacaactactaccttccgccgcttatttaagaatatgtatggagtgccggtatacgaatggattctgagcaagaaaagagaaggtatcctggaagatctccagcacaccaaacaacgcatcactgaaatcagcaatcgttatggtttcgattccttatcacattttgcacatttctgcaaagcttcttttggagactccccgcgtgcccttcgtacacgtgcagccaaaggtgaaaaaattactactctaaaaacagaatagaaaccgccctttgcctggcaaaagagaaacggtccgctatttggcatccatagtaagcagaccttctgttccaataccctccattatataccaggacgataaccattaccacaaaactttataaacatccacttccttgatgaagcttttattggtgagttattccggttcttcttcaaatttggtggtaaattctttatttctttattttcaagttgataattgtcctttttgcttgctttaataagaaaaaccagacaccggctgaataagataactcaagtttcagaagtgaatttgcgccgtccggaccggtatcttcatccttatacctttcttcaattaacattgttaacgccttttgcagttcgtcaggttcttatgcgcaaataataaggcttttgcatttaaagaacttgttattcacatccaaagaacaagctttaactctgtgttaaaacaaagcttttgaggatagaaatcttactttttaaagatattgattttcagatggtttattctaaaattcgcttcttcacctcatggatggactcttcgggggaaagccgggatacttgcttttttgtcaactataaacgagagcttacacttccgaaaacggaattagattccatgagtaaaagaaaacttaccaccaaatttggagaagaacccttattccacgaattatttatttaacagtgctctaattcgcctattcatcggcttctcaaaataatagtaagagagcaggcttaacgagacgatgacacaaaatagaatcggaatggaaacgtaccagactatatgaaagttattttctttctgccactccgcataagataacaaaacaaaaagatgaatcaggtaaaagctaaagctaatctctcccccaatcactaaaatacgattggacaaaagacgtgagacccaacccttttgcagagagaaactgatcaggatgaacgcgatcggcagccaatagtaacaggaataccgatatacttttggaacttcagcagcatatagatagaatacccaaaataagacgatcgatattatttcaataatacttccttggaaagatgtgatgtttttatttttcaaacggtcgtacagttgaaacaacaacatgccgactataaaatccggaaatcgagcaatcggattaacgtaccaatatccttttatatcactttccggagtaaaatacataccgacaataaccaatatagcggaaattaaaaatacacagaacaaacccttatagtttcttgctatcggcaccagaaatggaaaacagaagtaaaaaagctgctcgcaacataagctccacgaaggactgttaaatgaaaaaagtaatcagctttaggtatataggcatttgttaatgtgagtgaagccaaaaaatgcttgctccaatccgtaaatcccgatgcaattacatagcctcctaaagcggcagcaatcaataaagtcaggacatgcaaaggataaatacgggctatgcgcgctacccagaaagatcgtttggtcattttgctttcacttagtttcttttgataattgtatgctataataaaaccgcttagtacgaaaaagaaactaacaccgacaaaaccttctttaaaaaaatgaagatcgaaaaagtcgtctattacataacaatgtgctccaaaaaccattaaagcaaatataagtcgcaaagaggtgagtgtgtttatcataaatctggtgttgcctgtttcttttgatcattccttctccgagatgcaaaattaagaaaagaacagttcgaatatgcactaaacaacttctttttatacagatcaaggttaacttcttaagaacaaataatttactcttctaacagattcacaataaatcacttataaacacaaccggcaatcctttgctaggtttcctcatggagtgctttcagtcaatcagttactattttaccggccctatttatcctattctctccgggcacttcagattaaagaattatttctttaattctttggttaatcaatgtatttcgtgtacttttgcacaatgagaaagaaggctcgtaaaacagaaattatagttctaacaattaaataatttaaaatcaatcatttatgtggttaagtaattcatctgtaggaaggaaagtggtgatgagcgttaccggtatcgcccttgtcctgtttctaacgtttcacatggcgatgaaccttgttgcgatcatctcggctgagggttacaacctggtttgtgagttcctgggagcaaactggtatgcgttggtagctacgctgggcctggctgccctcttcgtgattcacattatctacgctttctggctgacaatccagaatcgcgcagcacgtggtagcgaacgttacgccgtagttgacaaacccaaaaccgtagaatgggcatcacagaacatgctggtgctgggtattatcgttatcttaggtttgggccttcacctctttaatttctgggctaaaatgcagttaccggaattgatacacaacatgggaggagtagcagacacaacttatgctgccgatggtgtttatcacatcatgaacactttttctaaccccgtatacgtagtgctgtacctcgtttggctgggcgccctttggttccacctgactcatggtttctggagctctatgcaatctctgggctggaacaacaagatttggatcaaccgctggaaatgcatctccaacatctattcaaccatcgttgttgtatgctttgctctggtagtagtcgtattcttcgttaaatcgttggcatgcggtgcttgctaaattgtaaattgtaaatgattaaattgtaaatagcattatgactaagatagattcaaaaattcctgaaggccagctcgccgaaaaatggagtaactataaagctcatcaaaaacttgttaaccctgccaacaaacgtcgccttgacatcatcgttgtaggtaccggacttgccggggcatctgccgccgcttctctgggcgaaatgggtttcagagtattcaatttctgtattcaggattcaccccgtcgtgctcactccatcgcagcacagggtggtatcaacgcagctaaaaattaccagaatgatggtgactcggtttaccgtcttttctacgatacaatcaaaggtggtgactaccgcgcacgtgaagccaacgtttaccgtctggccgaggtatcaaacgctatcatcgaccaatgtgtagctcaaggtgtacctttcgcacgcgattacggtggcacactcgataaccgttcattcggtggtgcacaggtatcccgtacgttctatgcccgtggccagaccggacagcagctattgctgggcgcttattcagcattgagccgtcaggtacaaaaaggtactgttaaactttacactcgttacgaaatgctcgacctcgtcgttatcgaaggacgtgcacgcggtatcattgcccgcaacctcgtaaccggtgaaatcgaacgtttcgccgctcatgctgtagtaatcggcacaggtggttacggaaacgctttcttcctttctacaaacgctatgggttccaacggttctgttgccatccaatgctacaaaaaaggtgcttactttgctaatccttgttttgcccaaattcacccgacttgtatcccggtacacggtgacaagcagtctaagctgacattgatgtcagagtcacttcgtaacgacggtcgtatctgggttccgaagaagattgaagatgccaaagcattgcaggcaggaactaaaaagccgactgaaattcctgatgaagaccgtgacttctatctggaacgccgttaccccgcatttggtaaccttgttccccgtgacgtagcttcacgtgctgccaaagaacgttgtgacgcaggttttggtgtcaacaacaccggtttggccgtattccttgatttcaaatatgccatcgatcgtctgggtgaagatgtagttcgcgcccgttatggtaacctcttcgacatgtacgaagagatcactgacgagaacccgtacaagactccgatgatgatattccctgctatccactatacaatgggtggtatctgggttgactatgaattgatgacctctatcccgggtctgttcgctattggtgaagctaacttctctgaccacggtgccaaccgtctgggtgcatctgcattgatgcaaggtctggctgacggatatttcgtattgccttatactatccagaactatctggccgaccagattcaggtaccacgtttctctacagacctgcccgaatttgcggcagcagagaaagaagtgaaagataaaatccagaagattaaagctgtaaacggaaaacattctgttgactcaatccacaagaaactgggtcacattatgtgggacttcgtaggtatggctcgtactaaagaatctctgcagaaagctctgacaggtattcaggaagtgaaaaaagacttctggaccaacgttcgcatcccgggtgaagtaaacgaactgaacgtagaacttgaaaaagccctccgcctgatcgacttcattgaagtaggtatgttgatggctcgtgacggtctgaaccgtgaagaatcttgcggtggacacttccgtacagaatatcagactccggaaggcgaagcattgcgcgacgataagaacttctcttacgtagcatgctggaaatacaccggtgaagattcagaaccggaattgatcaaagaagacttgaactatcaattcgtgaaagttcagactcgtaactacaagtcataattcggttaatcaattaaaggaaaacaaaaatggataaaaatatatcattcacgctgaaagtatggcgtcagaaaagccctaaagcgaaaggtgcttttgaaacataccaaatgaaagatatcccgggcgatacttcattcctcgagatgctggatattctgaacgaacagatcatcaatgatggtggcgaacctatcgtatttgaccacgactgccgcgaaggcatctgcggtatgtgttctctttacatcaacggacacccacacggacctgcaacaggtgctactacctgccagatgtatatgcgtcgtttcaaagacggagatactatcactgttgagccgtggcgttctgccggtttcccggtaatccgcgacttgatggttgaccgtacggcctatgacaagatcatgcaggccggtggttacgtaagcgtaaacacaggtgctcctcaggatgccaatgccattcttatctctaaggacatcgctgacgaagccatggacgctgccgcatgtatcggttgtggtgcttgtgtagctgcttgtaaaaatggttctgccatgttattcgtatcagccaaggttagccaactgaacctgcttccacaaggtaaagtagaagctgcccgccgtgcaaaagcaatgctttctaaaatggatgaactgggattcggtaactgtacaaacacacgtgcttgtgaagcagaatgcccgaagaacatctccatcagcaacattgcccgcttgaaccgcgatttcatcatcgcaaaactgaaagactaagcaaaacttagcatttgattaataagtaggaaaattccccgccggtatcggcggggaatttttttatatgaaaagtattatttcttacgatgtctacgataccagataatgaagccgatcaggggaagtgaagcacccgaacattaaaagctactccttaccgctggattttcgaatagcccggggcgaagcaccgaacgacttcttacaaaaattggagaaatgaggcaaagactcaaaaccatatttgtaacaaatctccgaaatggtggcatcggtatacttaagatcatacataatcccctccttacggcgtttcagcatccattcgtagaccggttcgtggaagatggtattaaaaatacgacggaatgtagttacgctatatcctcccatgtgggccagttcctctacggttttcaccctcatatagttttgcagaacaaaatactgaaagctattggtatattgtgagagcggatgaaccaatgaagacaggtcatagtccgaataataataccccagaataaaagcaagttctttccgtttgagtgataacagctcccgacaaattttattttcactcaaatagtttttcgatccttcaaggaaatattgcaactccgggataattttgagaggtgagtaaatcaacggtgccggaatttcattcataatgtagttatagcgttgttcacaaaaaagctccggctggttaaaactgtaacacacacactctacatctgtcatagccaatacttccaactttgatccgatggcttgaagaataaactctccggcacgtaacatcgttccggcatattcctgactattgactaatatttccccttttaagaggaaaatcatcaggttctcttcacacttctgggcaggacgatgaaaacctctcggatgagaagcgtgcataatggcattatcaacagccttgggacatatctgacagttcatcttatctccacagaaggagtcggacatagcgcgttgtgttttgtttatgttgccgacaaatgtaggagatttttttgaaaaaacaattaagaaagaagaaaatggcataaaaataggttcatccgacaaatacgtaactggatatctttcccaataggattgataatcagaagattatatttaccatagttttcttttcaatgtaaaggtatttaccccggcatgtaaaagcatttacctcggtgcgtaaaagcgtttacctcggtacgtaaatgaagccggcatgcaaagtaacggatcccctcccgtaggataagcgtcggcaagacgcatccttcggatgaacctaaaaatagccctgaggtttctctcagagctatttttataaataacggcttacgaatactacttaggagtatcggtgaaatcccagctatcagcaactgaaccggtaatagccatcttctcagcgccttttaacgtcaatatgtaagcaatactttgtccagcagtccagtttccttcggtaaatgtaatttcctccggagtagttgttttatcgagcaacattgcgccaccagcttcagctttgtagtagatttcgaatgtaacgtcagttaaagcttgaggaataagcatggcagtgtaatctgctccaaccaaagtctcgttcgcagtgccaccgccatctgctcctacaatagaaagtgcagtagcaggttcaatggtatagcttgtggtagtagtaacatcgtcaggaatagcccatgtacctaatgttgtctcagtagtagaagtagctccataagtatacacacctttgtttttagctttaataaccactttatttaaagtgtaagtaataccacttccctctccttttattttaaagccaatcttcgtcaacgcgtgtttaaaatttaaagcaaccgcttctgtggtaccgcttatagctttttgcttattcatcgcttctgctaccaccaaatcttcctggtctttcacggcatctttcactgtataggtcagtgtaggcgctttgttagcagaagctgccccccaagaaagctgtgccgtagtgttaggtgaaaaagcaaagaaacttacttgatctgttgccggccaatagaatacagagccaccactgctccatgtgctttcttttaattcaaaatcagctccaggtatcagcgcattgacagctgtagcatcagcaaatgccccagtagtagaataggcatacgtcgtaaactttgtaaaatctgcgttcactaaagtcgtagctcttgttgttttacttaccgccgtattgaatccgatttccaccggctgtgcagccttttcaatctcttcattctgtgagcaacccgtaattgccattgcagcaactgctgcgaataaaatcttcttcataatagtatgtttttttaagttattaatgttttatctgtatgtattccttttttcttatccaacgggcaactccacatttgtttcgtcgtcccagtctcctacatcaccgccaatgccgccacctccacccggaggtacctccacatcgtctacttttatttcgtcttctatttcaactttaaccaatgtcggcggttgcgtttcatctccttctcctccttcaccaccgccggtaggttcttgtacggcttccgttatattaatcttcacttcctgcaccgacttgtccaccttaataatcatcaggttcatcatcaccggaagttcggtctcggcacggctaagaacaacttcgggtagcccaaaagtggtaaataccccttctatctttccggctttcacgttcagatcaatattaatcggacaggcatcacacatggcataaccttttcctaaaaaataatggtctgccatcccaccgacactccctatcacagtagaaacattactcaacccctgtgctttgatgctaaaagagtaagttctgactaccagccttggtttcaactccagcgtcaatgtctcctcactatttcgtacatccagatcatctatgtttatcacataaagcggatccggcccccaaaccatcttttctgttccggcaaccccaaacttacagagattggtgtaagcctgaatggtttcataagattcttctccacgaatcaagaccgtttctgtatcgtaattgtaaaccacaaccgagtaatgtccgggaggtaccggtacctctccaccggttaccgacaaatatgcactcttctttttacctctttcatctttcggataaaagataacctgcattccctccggtagtttctctgtcactccttcccagtttagcgcgatccgtactccactaaccggataatcatccagcagttcccgccggctgcatcccgtcatcagcaacaacgggcagaaaagcacaaaaagcaactgtcctatatctttcatccatctctatctccttgccgttataagccagaccaatgataccttggctttggtaggcccgataaaattgtaacgtccgctatttgtccagactaacgagccttcgtaaggagtatacttacggtattctgttgtcaagtatcccactcccacactaaactcaaacgaaagatggcgggctacctgtttcgcatatccatacgtaacccccgaggctgcataatactttccctgataaccatctcccttaaactggaagtcgtaaatacctccttctgcataacatcccagaaaatgtcctgtcagcctgccgtgtttccggcgatttcctaaccagcaacgtccttccacccctcccgaaagcagctgatagcagaactcttctctgctgttcagccaccagggacatttgtattcagtattcaaagaccaacgcttacctaatggtatttccacttctatattgggtgccaacgccaagtcataaagcagattgttcttgacggccaataccgtttgccgccgcaccttctccgattccattactgatttttccctatttaccatgacaggctctcctccggcaagtttaccgggaagcggtttagctgtttccactccatataccggctttgcttcttttaccgtcattgccggaagccgttttctttgcggtaccgacagttccggtaatatccggttcgcaatgtaatggtaagcttttcctccgttaagccgacgcaataaagactcacatcttacaggatcatcacgatggtaatccaataacatcagtacatctctctgatcgggcacctgtgaatctgcagcaatcttctcgtacaaaacagaccagtctattttttgaaaatcgaacccttctttccttatggcatccgtcatcgtcatcatcgcaaaaccttcacccggcaaaaagaaaaggatcccccaaaagatgaatatatagatgcgattctccatagttgctctatttgtataaagcaaatatagagctttgaaattaaacgaaatacacttaatctaactaaataaagggcctggtttgttgtgtgaaacgattggaacgattttgcaagtttgacgggatttatccttccctaaagactgctaaataaacaggaagaagagacattataaaggcatatccgtgaaaaaccgtgaaggaattcaaaagagagacaatattcagggaaatatttggagaatcatccgaagagaattacatttgtattgtgatttttttcatagtattagatttaaggttaacaaaaggttggagtcaggcgtgactccttttttttgtccttttatttaagcaactgatagactcctcccgccaagacccggattactcctttcatttccagttcaaacagaatgacactgatcttattgataggaatatcagcctgcaccatcaacgcattgatctgcaaatctcccagccgtccgagaatatctacaatcctcagttcttcggcagataaatcagggaaaagattccgctgtacggttgtcggtttaatagtatgtgaaccggtatcccaccccattgccttcacaaaatccgtcgcagactccaacaaaacagccttattgtcccgtatcagctgattgcaccctttcgaatattcatcagtgacccgccccgggaaagcaaaacagtcgcgatgataactcccggcaatatccgccgtaatcagagaaccgcctttagcggcagactccaccacaatagtggcatcgctgataccggcaacaatacggttccgactgatgaagttatgtttatccggatttgttccggaaagaaattcagttaacagtccaccctgccggagcatatcaatggctgttttacgatgtaacgaagggtaaatacggtccagcccatgagccaatacccccacagtagggagttcgacagccagtgctgcccggtgggcattgatatcgatcccataagccaatccgctgacaacaagtacatccggacataaagcctgcaaatcctgcaggaaactgacgcaaatttgtttcccgtaatccgttgcattacgggtcccgaccatattaataatgtggaaagcattgagatcggcttttcctttaaagaataatacgacgggagcatcatcgcattcacgcagtctggagggatagccctcatctgccatcgtaaggcaagagatacggttatcccgtacaaactcatattcctgttcggcacgcttcaatgcctgtggagaatccaatgctgcgacaactgcctgattcactccgggtaagcgatcgggcaattcagtccggtaacggaatacatcggcagcactccccataccgtctaccagacgtttggcacctatatgcccaacgcccggtatttgcgtcagtgcaatactgcatatccgttcttcatcggtgctcattgcaggtaaggcgcaaaaatccggtcgaataattcactatcgctcaaacgtccgtttaccacacataccgtttccaccgtcgatttaacgacaaccttattatcgcttttccggaagatgtcctgatagaacacatatttgataccttctttcttcatatacaatttggaaacgaattcatcaccactctttaatggggttttgaaggccatattaatgcgggctaccaccggatccacgccctcttcgtgcagttttgcaaaacttacgcctaccgatgaaagaaactcatgacgggtatgttccagataatgttgataattagcgttattcacaatgccttgcaggtcgcactcgtagtcacgtacctttaaagtaagttcatagatatacttttccatctttattccagtcctttaaattttttcagttcttcggtcgaaaccaatttatacagtttgtcactcggacgtatcttatccagcttcatagagaagtgctctcccttcttcacggtttctaccggtttcaggtccacacgggcctcatcgagcgtagcaaacacagctccggtagtagggccggtaatcaacagcttatcgcctacactcacttcagccgcttccaccaggaattcggctacaccaatgttggagaagtatttaatacctttccccacatagatcttacgttcggttgccgccgatccgtaattcttagtccattctcccagacgctgtcccagatagtaaccgtcccaaaagccccggttgaataccgttttcaagcgttcatcccacgccgcaatcttctcgtcggtaaacgtaccatccagacaggcctgaatagcctgcttataacactcgacaacagtacgtacatattcgggcccgcgggcacggccttcgattttgaatacacgcaccccggcatccatcattttattcatgaaatgaatggtctttaaatctttgggcgacatgatgtactggttgtcaacctcaagttccacatcggtatccttatcacggacagtgtaagaacgacggcagatctgcatgcaggctccccggttggcagaatgattcatttcatgcaaagacagatagcacttgcccgaaacagccatacaaagcgctccgtggcaaaacatttcgatacggatcagctctccgcccggtccacagatatgttcttcctgaatctgacggtagatctccgctacctgttccagattcagttcgcgcgccaacaccactacatcggcaaattgcgcgtaaaacttcaaggcttctgcattcgagatattcaattgcgtagacagatgcacttcctgaccaatcttgttggcataactcatcaccgccacatcggcggcaatcacagccgaaatacccgcttccttggccgcgtcgacaatggtacgcatcagttcaacatccttgtcatatatgatggtattcaccgtcagataactcttcattccatgttcgtcacaggtccgggctatctcgcgcaagtcctcaatggtgaatgtattggccgaacgtgcacgcatgttcagattctcaataccaaaataaatagaatcggctcccgcctggatggctgccgcgagcgattcgcgtgagccaaccggagccattatttcaaagtcacttatcttatacatagttaccaattataagttacgagtccgtaactactgaatatatcctttttctttcaggtttgccactatctcctgggcaatccccattccgatctgctgacccgcttccatggcctcggcagtcatcaccggagtggactcggccagcttctttcccacaggcgattcatagaactgggtaatcttcttcaggtcgtttatcgtcagatacctgtaataaatagatacatatatatccataaactgtgtgtttgccttttcggacaactgctcttcaaaagttttccagaattcatccggaacgttcgaataagtatgtttcatcatcccgatcatctgcggaaccatcgatttcatagtagtcatagcgcccgaagcctcgagcatcttgcttaacgcctctttataagcagcatcctgagccgaaacggaagtggcagacaagataaaagtcaggcacagagcaatggaaaatagtcttttcttcataatttctatccagttaaataaatgaatggagtgcaaaggtaggggttttttccgtacttttgcagccaaataatgaatagaaaatcgtaaaaagatgaaaataggccacatagacctgggtgaacgccctgtatttttggctccgatggaggatgtcaccgatcccgctttccgcctgatgtgcaaaaagttcggagccgatatggtatacacagagttcgtctcgagtgatgctttgatacgttccgtcaacaaaacaactcaaaaactgaccatctgcgacgaagaacgtcccgtcgccattcagatatacggtaaagatacggaagccatggttggcgcagcacggattgtagaagaagcacaaccggatatattagacatcaacttcggctgtccggtaaagaaagttgccggaaaaggagcaggcgccggtatgttgcagaatatcccgaagatgcttgaaataacccgtgccgtagtagatgcagtcaaaatacccgttactgtaaagacccgtctgggatgggatgcggaccataaaatcattgtcgacctggccgaacaattacaggattgcggtattgcggcattggccattcacggacgtacccgggcacagatgtatacgggcgaagcggactggaccctgataggggaagtaaagaacaacccgcgtatgcatataccgatcataggaaatggcgacgtaacttcggctaccggtgccaaggagtgttttgagcggtatggagtagacgctatcatgataggacgtggcagcatcggccgcccatggatattccgcgaagtgaagcattatcttgaaaccggagaagaattgccgcaggaatcctttgagtggtatctgaatgtattgcgtgaagaggtgctgaacagtgtagcccgcctggacgagcgcagagggattatccatatccgccgccatctggcagcaactcctttattcaaaggaatacccaacttccgggaaacacgcatcgccatgctgcgaacagaatcggtagaagagcttttccggatattcgatgtacttcaccccatcacttaaacatcggcactgcaaaccatttcttgaacatctttgtcaccagcacatacagcacgaaagcagagataaagcccgcaatcgcatcaatcagataatgtgcctgaatatagacagtagctccgcaaagcaacagatagagcggcaacaggcaggcaaaaagtttcttgctgccacgccaagccataatcatcagaatagtcgaaacaccgacatgcgaactgggaaaagccgccgtaggacgttctcccacttgttgcgaaccctctaccaggctataaaagaatccatgctgatagccggggcccggaagcaactcctgattgtgattgaaataatcgccaatggcaggaaagacaccttgtgagacagaatccatgccaatggcagggaaatagaactgaggaccggcaaccggaacgaatatataaataaggtagtagatgaaaaagcaggtgaccagtacaaacgacatcttctcaaacagatcgaaccgatagatgaaatagaacaacgtcaccacgagaatcatcggataatatgcgaagtaccccatattgaagggttcactcacccacatttgcggaaacgcgtggcaaaaccatacggcaggttgccctccgaacatccactgttcggccgtagcaaaaagatgatccaggttggggaagacacggttgaactcaaaagtatccggataccagtatgacaaaagactcatctggatagcgatacgcacaaaagcggaaaacttacatggagccaaccggtagagatacatcagcaaaaaagtcattgctgcaatcactgccctgtcccacaacatgtggagcggatggtccatccgttgaaacatgaataaaatcaagatagaagttaacagattatatatcaatgttatcttctcaacagcaaacaagcccttacggctttctacacgtttaaataaatctaaagccatccttcgttcttataccaggcaatcgtttccttcactcccttttccaaatcgtattcaggagcatatcccagttctttcacagccggagttatgtcgcattgccaatttctttgtttcattattttatatttgtccgaattcagtgtgctgctctttcccgaacgggtcgctataaattcggcgagcaaagatacgacttttagcacaattaacggacatttgatgtgaataacaaacggactccccaattctttttgaatcagatcggagaaagcacggcttttatataccttcccgtcagccagaaagtaagcacgccgggatacttccttctcaattcccagaaaaatagcctgtacaatatctttcacatacacaaatgtcaaatcctgccgtttatatcccacggagaaatccgtatgctgccggatggacttcgccatcaggaaatagtctgcctcacgaggtccgtacactcccgtcggacggtaaatgacatacggaaaaccgggcaggctctggatataaagttccgctttcagcttacttaatccgtaagccgtattcggagccggagtatcttcttcacggatgggagtataatccttttcacgtatcggaccgaatacactcagggtactgatatagatgaactgcttgggaatcatattgagctcgcgcaacgtatcgacaaaatatttggtctgcagatagttgacacggtcgaagtcgttcttgtccgcacacttggtcacgccggcacaatggacgatataatcgaatttattgtacgtacctttatggccggacagttgtgcccgcaactcattggggtgtgcaaagtccaactcaaggaagtgaatcttgcgttctttcaggtatttcttactgctggatgcacggatccccgcccagacaccaaacctgcgtttcaaagcttcctgaacaatgaaactgccgataaatccgcttgctccggtaattagaatactctccataaaattcagatcaaatgataattatttcgttggttccacatgaatgcctacatgggttcctttcccaaacatctcttttagtttattttcgatagcagtagccgtgccatgcgcctcttccagagttatcttcccatccatgcggacatgaatttcgatggcataataactgccgatcctgcgggtacgcaaatggtggggctgactcactcccggaaaagagagtacggtctgttcaatctctttctcgacatcgtccggcaaggacttttcaagcagttcgtccacacaaggaatcagcaactgcacagataccttcataataaagaaactgactaccactgcggcaatcggatcgagtacccgccaatgatctcccagcaaaatggcccctccaataccgatagccgttccgatggatgataacgcatcactccggtgatgccaggcattggctaccacggcctgagaatttaacttcttgccctgaatcacggtatactgatacagtatctcttttgacacaatcgacaccaatgccgccaccaatgccactacaccgggagactccaactgtccgccctgcaaaaaagtataaatggaagaggcaccattccaaaagataccgaagccgacacacaaaagtaacaacccgatgatggccgtagccaatgtttcatatttgccgtgcccataatcgtgccccttatcttcgggcttcccggcgatacggacaaagacaatgacaacaatatcggtgatgaagtcggatagtgaatggacagcatcggccagcatagccgcactatgcccggcaattccggcaaagaatttaaaaacgagcaaaaggaagttcacgatacttcccacgatcgttactttataaattcccttctccctggaagacttttcactttccatttgttagattattcataatgtgaggggcaaatgtacatgaaaatcttgaattattaatatttaatcgcttactttgtactgattgatataaaacgaaccgattatggctaaaaagaaagaaaaaaaagccggcaaaagaatgaagaagaaagaactgtcaaaggtggttctcgatttcttccatgccaaacaagacgaggttatcagcctgaaatatattttctcggaactgaagttaaccactcatccgctaaaaatgctctgcatggatatcctggccgatctcctggccgatgactacattaccgaagtagacaaaaacaaatataaactaaacaatcacggtgttgaaatgaccggaactttccagcgtaaaagcaacgggaagaactcgtttatccccgaaggaggcggagacccgatttttgtcgccgagcgtaactccgctcatgcgatgaataacgataaggtgcgcatcgccttttatgccaaacgtcgcggacgcgaggccgagggagaagtgatcgagatactggaacgcgccaacgatacatttgtcggcacactggaagtggagaaatcatatgccttcctcgtcacggaaaaccgtacgcttgccaacgacatctttatccctaaagataaactgaagggcggaaagaccggcgacaaggcagtggtaaaggtcacagagtggccggacaaagctaaaaacccgatcggacaagtgctcgacattcttggcaaagccggtgacaatacgactgagatgcacgctatcctggccgaattcggattgccatacgtctatccgcagtcggtagaaaaagccgcagataagattcccgcagagatttccgccgaagagatagcccgccgcgaagacttccgaaaagtaaccactttcaccatcgacccgaaagacgccaaagactttgacgacgctctttccatccgcccattgaaggacggactttgggaagtcggcgtacacattgccgacgtgacgcattatgtcaaagagggaagcattatcgacaaagaagccgaaaagcgtgcaacttccgtttatctggtagaccgcaccataccgatgttgcccgaacgtctctgcaacttcatctgctcgcttcgccccaacgaagagaaacttgctttctctgccatattcgacatcacggaaaaaggagaagtgagagactcgcgcattgtacacacggtcatcgaatcggaccgccgcttcacttacgaagaggcgcaacagatcatcgaaaccaaagagggtgacttcaaggacgaggtactgatgctcgacaccatagccaaggctctgcgtgaaaagcgttttgcggcaggagccatcaacttcgaccgttacgaagtgaaattcgaaatcgatgaaaaaggaaaacccatcagcgtttactttaaggaatccaaagatgccaataagctggtagaagagtttatgctgcttgccaaccgcaccgtagcagagaaaataggcaaggcacccaaaggaaagaaggccaaagtgctgccttaccgtatccacgaccttcctgatccggaaaagctggacaacctcgcacagttcatcgcccgtttcggttacagacttcgcacaagcggaaccaagacggatgtctctaaatcgatcaatcacctgttggacgacatacaaggaaagaaggaagagaacctgattgaaaccgtatctatccgtgccatgcagaaagcgcgctactctacgcacaacatcggtcattatggactggctttcgactattacacccacttcacctctcctatccggcgttttccggacatgatggtgcaccggttggtaaccaaatatatggatggcggacgcagcgtatcggaaacgaagtacgaggatctgtgcgaccacagttcgaacatggaacagattgcagccaacgccgaacgtgcttccatcaaatacaaacaggtggaattcatgagcgaacatctgggacagacttatgacggagtgatctccggcgtaacggaatggggactttacgtagaactaaacgaaaacaaatgtgagggcatgatacctatccgcgatctggacgatgattattacgagttcgacgaaaagaactactgcctgcgcggtcgtcgtaagaaccgtatctacagcctgggagacgcgatcaccatcaaagtggcacgggccaatctggagaagaaacaactggacttcgcactgatagagtaacactttgtcaaaatgataatcgggacccgctcagattgccttatttccggcaagagtacgtccgcaaagaaaaatcgccttccacacggatcggcgattttctttttattatccagatagggaaagttggacaaaagcgaaagtataagtacatagaagccggacaaagaaaaagaaataaaggatataaggaatcattttatcttttcctaagcgctcgccattcggaagcaaccagagaaatatatggattcacgccgctccgaaacaccggtaaaagaagatgtgaaacaaaagacctttgttttttccaaaaagaagtaagcatttcacccgaaagaagtaagcgttttcggaaaatgcttacttctttttcagaaaagcaaggggcttcaacccgaaaagcccgggtttccgatctccaaagtccggctgttggagtccaaaaatctgtttttgtgttcctgtgctccctatcagtccgataaaagagaaagtatatgtaagcggaaacagccatttacttactttttgaaatgaaacacagacaaaacgcagcaatcggatcatccgacaaattctaatatataaaatccattccgacaatgtatccaaggtgccgtgcaattctttgatttaagtgtaaatgcgacagttcttctttttaccatatacattcgtacccgcttatcaactctgctcattgccgcttcatcatttagcatttcaacaataaaaccaattttcattcggtcatcggaattaaaaacagtatatttgccgctaactaaacaaagtcgtaatacggagtaaagcaactcaataaaagaacatcacaaacatgcttggaataaaactgatcatagcaatactatttgtaatcatcgcattactcagcatcttctttataattatcagagcaatcaagaataataagaactggaaaataatagaacctgaacttataaagaaagttcaagagtccaccaggcaagaaattatacatacaatgacgttaaacgccagcgattcaactgacttctccaacggcaagggttttttactatggatagcatttacatctgactacacagcttttatcaataagagctatattgccgatagcggtaatggacatatttatctttcaagaagaatggatacttcaatgaaaagattagagaaaagatttatggaacttgagttcaggaacaaggaatccgcagaaatattaaaattagacgtactggtccgtcccaaagatatagagatactaagcgcatttattcccaataaaaaatctttataaagattgacagtacaaaaaccgatcgggaaacccgatatcgaacgtactttcatctgctacggcagataaaggcagaatgcagacattttaattatttattatcacaaaataaaccaagaaatcaatgaaaaaagttattcttttactcttactcggagcatgggtattcacaagtgttgctcaggaaaaggtatttcaagtaaacgaagtgtccgtcattaactatggtgacggacggttgctgttccgggaactgaacgaggaaaaaacaccattgcagggcgaataccgcatcatcgacggctatcattcggaatatatcctggcttctttcaagaatggcatgtacgacgggctgtatcgccatttcaagaggaatgttcttgcggaggaaagcacatacaaggatggatggagagaaggctatcgtaaaacatattatggcgacggcaaaaccctgcagggcgaaggaacgttcgtggaaggaaagttgcacggtgtctgtaagtcatactatcaaaatggaaaagtcgaaacggaggtctgctataaaatgggagaccaggacggatgcgaccgcaaatacaatgaggaaggaagcctcgtgcgcgatacttattataaagatggcaagcccgatggaaattgggtggagcatctgtccggtagtattgatttcacccgtcgcagcagctataaaaacggattgctgacgggcgaatattctgaaacgctaaagaatggaaatctccgtaaaaaaggtacttacaaggaaggcaaaaaagacggaatctggatcgaatatcgccgtgatacgggcatccccgaacgttcgactacctaccgggcaggggaaaagacaggagaagagattcgctatttcactgatggaaagcccgaaagctccaaaaattacctgaatggcaagttggaaggcattagccgcgaatattattatagcaacggccagctaaagtcggaattcacctacaaagccaacaaacagcatggcccttttaaatatctgaacgaggacggaaccgtccgcgaagcaggccgttacgaaaacgatatgcggaaagagtaattctgccggaaccagtatggaaggcggttttacatttatagataggaatatgaataaacacatttgtttttatgaatagaaagtggatcttaataacattgtgcattatactactatccggttgtataaattttgggaaacgttcgtccactccgaagactcaatcacccggcaacgaaaccgaacaatcagaacacgccatcagtcagcattggattgggagctattctttatatatcctctcaggagaaaccattcaagaagatgccagcaacatcggagtcggttatgattttgaaattcaggattcgatggtttcttttacagcagagggctttcagacgtttttcgtgtgtgaatgctcggtccgggaaagcaaagatcagttgttgttactctacaaaagaaagattgaagagactactaccgtaccttttagaaacgagggcgatacggttgccctgattatctgcgaacagggaaaatattatgtgcaaagcccggtcattccggttgccggatgggtttacaatcaaaagatattgctggagaaggagccggttaatacatcagaggaatcggatcatgactcgatcccggaaataacctattgccacgaggactttgaatatggcactgaagaagatcatttagaccgttgggtcattcccattgacgaagctgaatttttagctgcatcggctaactataagaacatacagccggacagcacggttcagttacccactgatcaagggagctattctgtttcactggaaaatgggcacacaaaagtgttatccgattgctatgaacaatccgatgcgtatcgcaaatacctatacaaaggatatcttgcagaaatgaattgttatgtattcgaatacgaaggccttgagtgggaaggaatttcatacgtctctaaagcgaacggggaagaatacggtctccgcacccaagctttgttctctttgaatcagaattgttattgtgtggatgcatgcaccgagcttgaaggcgaaagagccggaattataaaggtatttcaggtctcaggcggcgaattcaaattcatgttcggcttatggtcggacaagatattcccgcaaaccgtttgctggaaggataacaccactctttatgtgaaagccctccgggaggaaaatggcgcagatcaaacttattactataagatacctttggatcaggtacaatgattcgcttttggtaaatgaccgataaagaggctgtctcaaaattttatttttgagttcagcctcttgttttattgtctattgcttttcttacctaatctttttatactcttttccctcttattcttttataataaagcaatcttgtaataataacatcgttcgcccgactataaagtaaagattaaaacaaatgaagtcgaacaaaaatgaatttctgaagatgttgactgcctatcaggggattatccacaaggtaaaccgggtatatttcagatcggaagcggacagagaggacaactttcaggaaaccgtctatcagctctggcgatctttcccggcattgcagaacaaggagaaacccgcatcgtggatctatagggtagcaatcaatacctctatttcgaaaataagaaaggatagtcgcatcgagtttcatgactcgccgccggagggagagaccgttgacccttgggaacagcaggaacaggacgaaaactggcaaagacttgtcaatgcccttcaaaagctgaatgaaatagacaagtccatcatgctgctttatatggaagactatagttatgaagaaatagcagaaatagtgggaatgagcagctccgccgtcggcgtaaagattcacaggctgaaaagccgattacaaaaacaatttaaaaagtaaagcatcatggaagcacatgacattaaagaaacctggaaagcgggggtggaaaagaatatcaaaccgtatcccgaagagaaactgaacgagatggtaatcaaatccgcgagaaaatcaatcaagacagtgtatcccggaaccgtcttccgactcgttgtggtcgccgtggttgtttaccttattgtaatgctgtttataagagagcgaagcatggaaagagcgtacgtggatatagccgctttggccgtattgtccgtttcctatttcctttgggaacgttccgcttacagaatgcggaaatacaccaacggcatggctgtaaaggaatggttggaataccggataaaagaagttgagaaagacgtcaaattcaataccaaatatggttggatcgtatatacgtgttcctttctctcggcaataggcttctatgtgttctatctgatggcaatgaatataactcccggcatattgaacgttgtagttgtcccactcggcatagccatttacctgctgatcatagaccgttctttaggacggaattaccggaaaaccctccgtgaactgaaagatttatataaacagtttgaagtggaggattgaaaacaactatatcaaggaaacgaatcatcatcgagcaggcacaggcacttactataagcaccggtacatccccatccgaccggaaatcagaaagtaaaaaaacaagtagacccggtctgtcggaagatgaaagtcggaaagacggacttttatcttccggccgatcccggaaaagaggaaagattattatcccaagcatccatcaacgttcttgctgaaaggtgaaaaagagaaatgacgccgcttcagagacagccggtcattgccccatgccggactaccgcttaaccgtaaagacctgactctgacctgccggaattacaacttccttcaccttccgcccgatcttcaaacggcaggcatttccctgttcggaaaatacctttaccacagttttacctgatttactccatgtaatatctataatgaaaccgccgcgggcacgcagccccgtaacctttccttctgcccatacatcgggtaatgccggcagaacgtctatcacaccgtcatggctctgcaacaacatttccgccacaccggcagtatacccaaagttaccgtcgatctggaaagggggatgtgcatcgaacaaattcttatataatcccccatgccgatttacttccggcccaaagtcggtgggggtgaataaattccgtataatacggtaagcgtgatttccatcgtgcatacgggcccacatgttgatcttccatcccatactccagcccgtagcttcatctccacgcaattcgagcgtacggcggactgcactgacaagttcgggtgtcttgcccggtgttatttcacatcccggatggaatccatacaagtgtgacaaatggcggtggtgcggttctacttcatcaaagtcttcactccactccataatctgcccccgctttccgatacggtaaggcaccagttgctttgctcccattacgtgcagcaagagagtatcggcaggaggaagaatagaatcggcagctaaaatcgcagctgcttcggccgtattgctgaagagttcacgaataatggccatatccatcgccggagccggagctacggccgaagttttcttttccggagtcagaaactgattctcgggtgaaactcccaacggagtttgccacatcccgtctttttccaccagccaggcgttataaaaccgtgcggcatcgcgcatcagcggataggctgtctcacggagaaacttcttatcccccgaaaacaggtaatgatcccacaaatgccggcaaagccagcctgcactcatattccacataaaccaggtaggttcaccgtctgccggtcccgactcacgccagatagaggtgatatgatgggaagtccagccgggaaggttatacatctttgcggctgtagcggaaccattgaccgcaagttcccgaatcagtcggaaaagcggttcactgcactcaggcagtccggtggtttcggccggccagtaattcatctcagtattgatattaatggtataactgctgctccatgccggaaccacatccttattccatataccttgcagattggcgggttgtccgccttcacgtgaagatgctatcagcaggtaacgcccatactgaaacaaaagtgctgccagagcattgtccggattgtccctgaatccgataatacggcggtcggtaggcagaccagaatagtctttctccgatttcaaagtcaacgccacacgaccgaacagccgttgatagtccgccaagtgacgtttcttcagatcttcataaggcagctgcccggcaacggaaagaatcgtatccaacttggcctgataatcactgccgtcctgtgaaggacttctatcaaagccattatagctggtggcagcagcaaccaaaagaattatttcaccctctccgctcactttcaactgattgtcttgcaaggtggcatttcctttcagtaccttcacccggctttggaaaaacatccctttgccgccaacctcatcggcatacagcacttgtttgtcggtctttcggcgtccgtgactatcgaaaagttccggatggcgatctgtcaatctgttcttttcgaggaagtccagcgtccgccgctctacacaacccggagcctgtcccgaaagaatcaactcttcacccgtaccatcaactttcgctgtcggatgctccgatgtatagctcaccgctacatttacgggcgaccgacgtgaagcagagatacgaatcaccattacccggtccggattggatataaagtattcacgggtatagcggatgcctcctgcctgatagcgaatagtatgtacggcatcttgcagattcagttcacgcacatagttttccacctttccctgaacatcaaagcttagaaaaaggtcggccagaggttgatagctctgcgaaagcctgccttgccagttccgggttatcaatcggtgggcacccgcataatcgccatggttcaacaaggcaagcacttcattgtatacacttccgatagaaggtacgccaacaccggaaaaaggttcaccgctatatagtgtgctttcattcagttgcaaatgttctctcccggcatctccgaataccatcgcacccaaatatccatttcccaaaggaagagcttcattccagttggcagcaggctgccggtaccaaagcgaaagattatttccgccgaacaacaggcaggcttccagtaaacaaaaaagagtggtaaaaatgtgtttcttcataactatcagagttaattcatttcaaaaactgtatttctatattcccggaaggcaaagttattaaaataaatttccatctttgtattcctatcaagagaatatagttatgaagacagtaatcattgaaaacaaagagcaggtagaagaaattatctcccgttgcgatatttgctttgtcggtatcaccgacctggaaggcaacccttatgtgatccccatgaacttcggctatcaggatggagtgatctatctgcattccggccccacaggcagcagcatcgatatgctggcaaaaaataaccgtgtctgcatcactttcagtgtagaccacgaattggtattccagcaccccaaggtggcatgcagttatcggatgcgggccaaaagtgtgatttgcagaggacgcgtaaactttatcgaagacctggaagaaaaacgtgaagcgctcaatatattgatgcggcattatagcagccgggaatttgtatactcagatccggcagtgagaaatgtaaaaatctgggagataccgattgaaaacgttacggcaaaagagtatgcggtgccgcatacgaaataaattcaccacagattacacggattcactcagaattttgatccgatagttagtaagacgaatcattaatctgtgcaaatctgtgtaatctgtggtgaacaatgcatcagagcggatactcctcgaacgcatacaagattgtcgacagatagcgttcgcctgtatccggcaataatacaacaatcaattttccttcattctccggaagtctggctaactcggtagctgcatatactgccgccccggaagagattccgaccaaaagcccctctttagccgccagttcacgactggtacggatagcatcatcgtttcctacctgtttaatctcgtctaccacagcagcattataggttttgggtataaatcctgctccaataccctgtatcttgtgcggaccgggagcaccacccgataataccggtgaatcggtgggctccacagccacaattcgtacagtaggattatgctccttcaaagcagcccctactccacttacggtacctcccgttcctactccggccacaaagatgtccacctttccatcggtatctctccagatctcctgtccggtagtacgtacatgaaccgcagggttagccggattttcgaactgttgcagaatgacagatccgggagtagccgcttgcagttcctcagccttggcaatggctcctttcatcccgtttgctcccggagtaagtacaagctccgctcccaacgccttcaacaggttcctgcgttccatactcatcgtgtcgggcatggtcaatatcagcttatatcctttggcagcagccacaaatgccaaaccgactccggtatttccactggttggctctataataacagatcctggcctcaacgtccccttcacttcggcatcttcaatcatggccagagaaatacggtctttcacacttccggccggattgaaatattccagctttgccactacacgtgctttgagccctttacttgcgttataattactcaactccagtaacggagtgttaccgactaaatctgtcagcttctttgctatctttcccatatctatctattattaaatatctgtttattagtaataggacaaaagtagtgcagatttggttcattctcaataccataagtatggtaaattcgtactacgaatgagggagaaatatctttctaaagaatccaaacgaaccgccggttacattccggacacagtaaaacgacgaatataattcgccaccagacaacaacccggagtatatacctgcccgtgatcaaagccctgcaattcgtaaagtgatactttctgattaccaatattcttcagtactgaagccagcaaagcattttcttcgtaacggtccgccatttccaaattccggtcaccggtaatcaatataaaaggaggtgtattcttacgggctttgttgcaaggcgcataccggtctatcaccggaataccttcgggcagcgcgcgttctttacgtatggtgaaatgtgtaacagtctgcccgctgataggaagatacgcagctatgctgtcagcatctactccatatttccgaagatatgatttatctaatccgaccattaaagtcaaataacctccggccgaatgtccggtaacaaaaacacgtttgggactacctccatattcttctatatgtttacaggtccaagcaacggcagcggctgcatcatcggtataagcagggtttttagctttaggactaagcctgtaattgacagcgactactgcaaatccttgattcataaacatctcaggaatgtgttttcctcccccttccaatcctccgccatgaaaccagacaatcgtcggaaagtcttttttcccaaccggataatagacatcaagtttacagcgttccttacggtaaccatccgtttcccccgcaggaatatacgaaatgtcttttactgttttgtacgtctcctgtgcctgtaaggtgaaggcaacgaacaggagaataaatgataaatactttttcatgctattaagtgtttgtgaattacttgggcaaatataatacaataacgacactgtttgaaaaaataatagcttcctttatacactcaatatcaaaaaagcatagataagtggttgtattaattcctatttaattacctttgtcaatatcataacctccaaacacttatttcaatatgagaaagatcaccctcattatgtttacgctgctaatctgtgcagcacaacaggtaaaggcacaaactgacagtatgctcatccggccgacagtagataagagagtcgaactacttagcattgttttccgtttaacgggtaatccggagtatagcaaaaacgatttcaaactctacacagaccgcatcgaatcgcatttttctccatataaaaaccacgaacttatactattcgtacgctcgttggtcaagactgacggtgtttcatacgatgcagtgatgagtatggctgtcaatctcgacgaccagttcaatctgcccgaagattatggttcactggactctcgttggaataggaatcaagtagggtcattcatcaaactgttaaagaagtttgtcaaagacagtcgtttcgatgccttttatcactcaaacgaaaacttatataaagaggctgtaaatcgttttatgcctatttacaaaaacatagatatccaatggtataatgacttctatggccagaagtccaacgaccggtttcacattatactttcaatgggcaacggttcgggaaattatggaccgagtgtcactgacaaggaaaacgtacataatgtcttttcaatcatgggagcatgggttaccgattccgtaggaatggttgtttatccatctgaattaatcttaccaattttaatccacgaattcaaccattcgttcgtaagcttcgatccggaaatgttccgcacaagcggcgaacagatttatgctgcggttggcgaacaaatggcgcgccaagcctatggacaatggtctattgtcctcactgaagcaatggtacgtgcggcagtcataaaatacatgaaagaccataacttcccggctgtcgaaatcaccaaagaaaccgtcatacaaaaaacacgtggctttgtctggataagcaagctggtcgatgaactcgagaagtatgcctctgaccgcacgacatacccgactctcaacagctatatgccacggctggcagaagcttacacaggctttgcccaatacaccgcaaactatgattctatccgtcccaaagtagtttcgatcgacgaatttaccaacggcgatacaaccgttcggagcgacatcaaaactattactatccacttcgaccgtcctttggtgggccgcggatactctatcaattatggtcacctcggaatggatgcaatgcccaagattttaaacgtcaactacgccaatgacaatcgtactgtgattatcggagtagaattgttacccggaaaagagtatggaatcactcttttagggctttctttccgcactccggaaggagatggcataaaaccctatgaaatttctttcagaacggcacagtgacacaaattctctctcattgtctgtgatccaggtagtaaaaggcaatcccattttggacaaaaagggaaagcagatgactgcattagcctaaaattgattatctttgcaccccaaaacggaatattattagagtaattgctctttttcaactttatagggttactcttccatttgatagaaatacacaactgattgataatataaaaaagattataatattatggcattgcaatgtggtattgtcggactacccaacgtaggtaagtcaacacttttcaattgtttgtccaacgcgaaagcacaggcggcaaacttccctttttgtacgatcgaaccgaacgtgggtgtaattactgtacccgacgagcgtttaaataaactggccgaattggtacatcccaaccgtattgttcctacaacggtagaaatcgtagatatcgccggacttgtgaaaggtgccagtaagggcgaaggactgggaaataaatttctggctaacattcgtgaaaccgatgccatcatccatgtactccgttgctttgacgacgataatgtaactcatgtggacggaagtgtgaatccggtacgggataaagaaatcatcgattacgagttgcagctaaaagacctggaaaccatcgagagccgcatacagaaagtgcagaaacaagcccaaacgggaggtgataaagctgctaagcaagcttatgacgtacttgtgcaattcaaggatgcgctggaacagggcaaatcggcacgtacagtaacttttgaaacgaaagacgaacaaaaaatagcaaaagaattgtttctgctcaccagcaaacctgtaatgtatgtttgcaatgtagacgaagcaagtgcagtcaacggaaacaaatatgtggacatggtacgtgaagccgttaaggacgaagatgccgaaatcctcgtggtagccggaaaaacagaggctgacatcgccgaactggaaacttacgaagaccgccaaatgttcctcgccgagatcggtttggaagaatcgggcgtagcacgccttattaaatcggcctacaaactgctgaaccttgaaacttatttcactgccggcgtacaggaagtacgtgcctggacttacgaaaaaggttggaaagccccacagtgcgccggagtaatccataccgattttgagaaaggatttatccgcgcagaagtaatcaaatatgaagacttcttgcaatatggctcggaggctgctgttaaagaagccggaaagttgggcgtagaaggaaaagaatacgtagtacaggatggagacatcatgcacttccgtttcaatgtataacacatctattttcacttatagactgaggagctgatcaaatggtcagctctttttttctcctcccctcaaaacgaaaactccccgctttctaacactatcttcaagcaaatcattatctttgcgcccgtatattatgcctaacaagcaacacaagaaaatatcatgaacatggaaagtactaacagacttcgttatcttatcgcaggaaccggaggcgtaggcggaagtatcgccggctttctgtcacttgccggtaaaaacgttacctgcattgcccgcggagcacatctgcaagcgatacaacaggacggacttaaactgaaatcggacttaaaaggtgaacatacattacggatggacgcttgcacggcagaagaatataacggaaaagctgacgtgatatttgtatgtgttaaaggatattccgtagactccatcacagaacttatcaaacgggcttcccatgaaaatacaattgtaattcctatattaaacgtatacggtaccgggccgcgcatacaacgtctggtaccgggaatcactgtactggacggatgtatctacatcgtagggtttgtttccggaccgagcgaaatcactcagatgggaactattttccgtctggtatatggtgcacaccgcggaactgtcgttcctgtgggaatgatggaagccgtacagagagacttacaggagagcggcattaaagttgaaatctctcccgatattaatcgtgataccttcattaaatggtctttcatctcggctatggcagtcaccggagcctattataatgttccgatgggagaagtgcagaaaccgggtaaggtacgcgacactttcattggactctctaccgaaagtgcagccctgggaaagaaacttggaatcgaatttaaagaagatatagtcacatacaatctgaaagttatcgataagctggctcctgagagcacggcatccatgcaaaaagacatagcacgcggacacgaatcagaggtacagggtctgcttttcgatatgataacagcagctgaagaacaggacattgatgtacctacctatcgggaagttgctaaaaaattcatcaaactataaagaaataattatgaacaaccttcttttatctatcaattggaatccgaatccggaattattcaatcttttcggcatctcaatccgttattacggactactgtgggctatcggaatattctttgcttatgtggtagtccactatcagtaccgtgataagaagatagacgaaaagaagttcgaaccgcttttcttttattgtttcttcggcatcctcatcggagcacgattaggacattgcctgttctacgatccggcatattacctgaatcatttctgggaaatgatacttccggtcaaatttcttcccggaggcggatggaagttcacgggatatgaaggactggccagccacggaggtacgctcggactgattattgccctttggctttactgccgtaaaacaaagatgaattatatggatgtggtagacatgattgcagtagccactcctatcacagcttgtttcattcgccttgccaacttaatgaactctgaaattatcggtaaggtaacagatgtatcctgggcattcgttttcgaacgggtagacatgcaaccccgccatccggcacagctttacgaagcaatagcctattttatcttattcctgattatgatgttcctttataagaactacagcaagaaactacaccggggattcttcttcggactttgcctgacagccatctttaccttccgtttcttcattgaattcctgaaagaaaatcaggtggactttgaaaatggtatggcactgaatatgggacaatggttaagtattccgttcgtaatcatcggtgtttactttatgtttttctatggaaagaaaaagagtgcaaaatgaaacatattattgatattaaaacctgggagagaaaagaaaattacgagtttttccttggtttccagaatcctactatttctattacttcagaagtagaatgttcgggtgccaaaacccgtgccaaagctgccggagaatccttcttcctgcactatctttatgccgtgttgcgtgctgtcaatgaaattaaagaattccggttccgcatcgattctgaaggacaggtagtctatttcgatacagtggatatgctgactcccattaaagtggcagataacggacgtttttttactgtacgacttccctggcatcctgattttaaaactttccatacagaagccaaagccatcattaacagaatagatccggataaagacccttatgaagcagaaaagacaggaggtaatgatctactggatgtagtgctgctcagcgccactcccgatttatattttacctcactgacctgtacgcaggaacatcgtcacggtagtaattacccgttgatgaatgcaggtaaagccgtcataagaggtggtgtattagtgatgcccatcgctatgaccattcatcatgggtttattgacggacaccacttatctctattttataaaaaggtggaagaatttcttaaataattatttgcccctgactatctttttgatatcgttcagtttgtttaatgcttcaatcggagtcagattattcacatccagattaagtatctcatcccggatctgacataagaccgggtcatcaagctgaaagaaactcaactgcatacctccacgattctcactgacttctgccagcggcttacctgaaattccctgctggcggttgtcagattcgagctgcttcagaatttcattggcacgtttcactatacttttaggcataccggccatcttggccacatggataccgaaagagtgctcacttccacccctttcaagtttccggagaaaaataactttgttatccacttccttaaccgatacattataattctttatacgtttaaaggatttctccatctcgttcagttcatggtaatgggtagcgaaaagtgtacgtgcttttgccttcgggtgctcatgaatatactccacaatggcccaagctatagatattccgtcataagtagaagtaccacgtcccaattcatcaaacaaaacgagactccgggaagatacattattcaaaatatcagatgcttcattcatctcgaccataaaagtagattctcctacagagatattgtcactggcaccgacacgtgtgaatatcttatccaccaatccgatatgagcactctcggccggaacgaatgaaccaatctgtgcaagcagggtgatcaatgcagtttgccttaatagagccgacttaccagccatattcggacccgtaataatgataatctgctgcgttgcattatccagcatcacatcattagctatgtatttctctccaatcggcaattgcttttcaattaccggatgacgcccttgacgaatatccagcacatcactgtcttcaataaccggacggatataattattctctttagctacattggcaaatgacagcaaacagtcaatgcgtgctatttggttagcattgatctgaatggcaggaataaactcactcagcgcttgcaccaattctgtatacaagcgggtctccaataccaatatcttatcttctgcacccaggatcttttcttcatattctttcaattcctgagtaatgtagcgctctgcatttaccaatgtctgcttgcgtatccactcttgcggcactttatctttatgtacattccgcacttcaatatagtatccgaaaacactgttataggcaatcttcaaacttggtattcctgtcagttcgctttcacgctgctgtatctgaagcaaataatctttacccgagtaagctatctgacgtaattcatccagttccggattcactccgtctttaatgactcctcccttatttatcaacaaaggaggatcattattaatttccttctcaatgcggtcgcgaatagaaatacaaagatttaactgctctccaatacgattcaaactggggttatcagcttgccggcaagcctctttaataggttcaattgcttgtaaagcaacttttaactgtactacctcacgtggagaaacccgcccgacggccactttcgaaatgatacgttccaaatctccaatccgatgcaactcgtcttcgatcaactccctgaaatccggtttacgaaaaaagtattctactacatttaatcgatcgttaataggcttctcgtcttttaacggaaataccatccaacgcttcagcagacgcgctcccatagggctgatagttttatcgattacattgagaaggctacttccaccatcattcatgctaccgatcaactccaggctgcgcactgtaaatttatcaagacgtacatacttgtcctcttcaatacgggctaatgaagtgatatgccccacctgagtatgctccgtcatgtccagatattgcagaatagctccggaagcaacaataccgtttttaagatgctcaactccaaatcctttcagatttttcgtctcaaaatgtttcagtaacttctcccgggaactggattcggtaaatacccagtcatccagttcaaaagtaaaaaatttacttccaaagtttccttcgaacattccacgttttccacgttcaaaaagaacctcttttggggcaaaattattcagcagcttatctacatagtcaaaaggtccttctgcagtcaaaaactctccggtagaaatatccagaaatgctattccacaagcggattttccgaaatgaacagcagccagaaagttgttttctttataatttaaaacgttatcattgatagaaacaccgggagtgaccaactccgtaatgccacgcttcaccaactttttcgttgttttgggatcttcaagctgatcacatatagccacccgcttaccggcacggatcagcttcggcaaataagtatctaatgcatgatgaggaaaacctgccatttcaatggtttttcctttcccattggcgcgtttcgtgagagtaattcctaatatttcagccgcaataatcgcatcggtagaataagtttcatagaagtccccacaccggaacagcatcactgcatccggatgcttagccttcaggtcaaggaattgtttcatcatcggggttaattcaatatcattgctcacggatagtcttcttttttaagttcataaataacaaggcaaagataagggtttcctactaatctacctaccttaacagatagttttaccatacctaaaaagatgtatatttactaaccttaccaattatcccgccaataaaatcggttacaccaatttctaaataaacctttcaaaaggaggtatatttattaataactttattaattccattaaaatatattataatataccgtttttcaccagaattatttgcagttttcgtggaaagccgtatatttgcaatgtgtttttcatagtattagatttaaggttaacaaaggttggagcaaggcgttgctccttttttatgtccctactccatgtctcatcgggaatcaagataaacatcgtttcaatccgattcaccacaaaaaatagtaattaaagatcctaaaacatttaataaaccgcacttttttcttaaaacgtgttataaaacatgcttttattcttggattatttgctattcccatgaaaagccgtacatttgcaatgtgtttttcatagtattagatttaaggttaacaaaggttggagcaaggcgttgctcctttttttatgtccttactccacagattccaataatttcccttccaaatgaatgtaattcattccacacagatggtcacactttcttcaaagagagattattttttccattgataaacaatatcaacccgtctcgcaatggcatattgaattaggaaaatataaagtagcggaagatgcacgatacacactgacagatcccagaaaaagtgtttttgataatgcggcgatattgactcttatcggaaaatgggataataaactcttcttttcggcaacagccaataaacaaaattatctgctttactatgatctaaaaccggtaatatccgactcccctatccgcaatattcattcgccataccgaaaaacactcattcatacctgaatccatgtctgatgacggaaaatatctgatctcgtgtgaaatacaggaaaatgatgagaatccggtgatcatattggccgaaaaataaaaaaatcgggatatattccataaagattatatcccgatcgttatcctttcagcacatcttcgtgctcaaacctattgaatgaatgtcatcatttttatcttttgagtaatcatatgtctaatcgatgattacaaatataaacactaaaatttaaattatcaacaaatataagatttttattttctgatccttccctttcatacctattttgttttttagctatcttcgtggttatctgaaaataatcatgtaaatttgctccctcatattaaagtatatattataaatcactataaacaaaaggttatcgctatggaatataatttcagggagatcgaaaagaaatggcagaaaatatgggtagaccaccatacctaccaagtaaatgaagatgcatccaaacaaaaattctatgtactcaatatgttcccttacccttcgggagccggactgcacgtaggccatccgctcggatatattgcttcggacatctatgcacgttataaacgtctgcaaggatttaatgtcctgaatccgatgggttatgatgcttacggactgccagccgaacaatatgctatccagaccggacaacaccctgcaattactaccatcaataacatcaaccgttatcgtgaacagttggataagataggattttcattcgactggaatcgtgaaatccgcacttgcgatccggaatattatcattggactcaatgggcatttatcaaaatgttcaacagctattattgcaatgatgaaaaacaggcacgtcccatcgaagagttaatagaagcttttagtaccaacggaacacaaggtatgaacgtagcctgtggcgaagaaatggactttactgctgacgaatggaatgctaaaagcgaaaaagaacaacaggaaatcctcatgaactatcgtatagcctatttgggcaatacaatggtaaactggtgtccgcctttgggtaccgtacttgccaatgatgaagtagttgacggtgtttccgaaagaggcggctatcccgttattcaaaaagtgatgcgtcagtggtgcctgcgcgtatccgcttatgcacaacgtttgctcgacggacttgaaaccgtagaatggaccgactcgctgaaagagactcaacgcaactggataggacgcagcgaaggtgccgaaatgaactttaaagtgaaagattcggatattgaatttactatctttacaacccgtgccgacacggtatttggagttactttcatggtgcttgccccggaaagtgaattggtagccaagttgaccactccggaacaaaaagccgaagtagacgcttatctggaacgtaccaaaaaacgtaccgaacgcgaacgcatcgccgatcgtagtgttagtggcgtattctccggaagttatgccattaatccattaaccaatgaacctataccggtatggatcagtgattatgtactggcaggttacggtactggtgccatcatggctgtacctgcacacgacagccgtgactatgcttttgccaaacatttcaatttggaaattcgcccgttgattgaaggttgcgatgtcagtgaagaaagcttcgatgccaaagaaggcatcatgatgaattctccccgtccgggaactcctgaagggggcctcgtactgaatggcttaactgtaaaagaagccattgctaaaactaaagaatatatcaaagaaaccggattgggacgtgtaaaagtaaatttccgtttacgtgacgccattttctcgcgtcagcgttattggggcgaaccatttccggtttactataaagacggaatgccttacatgatcgatgaaagttgtctcccgttagagttgccggaagtagctaaattccttcctacagaaacaggtgagcccccattgggacatgctaccaaatgggcatgggatactgtcaacaagtgtgtgacagacaatgacaaaattgacaatgtaaccattttcccattggaactgaatacaatgccaggctttgcaggttcttctgcctattatttgcgttatatggatccacgtaatcacgaagcactcgttgctcctgccgtagatcaatactggagaaatgtagacctgtatgtgggcggtacggaacatgctaccggacacttgatttactcacgtttctggaataaattcctgcatgatttaggcatatctgtagctgaagaacctttccagaaactggtcaatcaaggaatgatacagggacgaagcaactttgtttatcgtatcaaagataccaatactttcgtatctctgaacctgaaagatcaatatgaggtaactcctattcatgtcgacgtaaatattgtatctaacgatattctcgatctggaagctttcaaagcatggagacccgaatacgaaactgccgaattcatcctggaagacggtaaatatatctgtggatgggctgttgaaaagatgagtaaatctatgttcaatgtagttaatccggatatgattgtcgaaaaatatggcgccgatacacttcgtatgtacgaaatgttcctcggaccggttgaacaatccaaaccctgggacacgaacggaatagatggcgtacatcgtttcattaaaaaattctggtcgctattctatgacagaaacggcgagtatctggtaaaagacgaaccggctaccaaagacgaactaaaggcacttcataagctcattaagaaagtaaccggtgatattgaacagttctcctacaatacttcggtaagtgctttcatgatctgtgtcaacgaactctcaagtttgaaatgcagcaaaaaagagatattggagcagctcgttgtggtcctcgctcccttcgctccccatgtttgcgaagaattatgggatacattaggaaacaccacttccgtatgtgatgcacaatggccggcatttaatgaacaatacctggtagaagatacggttaattacacgatttctttcaatggcaaagcccgtttcaatatggagtttcctgcagatgccgccagcgatgtgattcaagccaccgtacttgctgacgaacgctcgttgaaatggacagaaggtaaaacaccgaagaaagttatcgtagtcccgaagaagattgttaacgttgttatttaatacctacacacaaaatgattagtaaacccacaaaatccgatgtaatgcgagagttgagagattatattttcatcactctcggactgataagttatgcgttaggctggacagcctttcttattccttatcagattactacaggtggaacaaccggtatcggtgccatcatctattatgcaacaggctttcctatccaatggtcttatttcattatcaatgctgtgctgatgacatttgccattaagatacttggtccgaaattcagtataaagacgacatatgccatctttatgcttactttcttcctatggttcttccaactgatcattgtggacgataaaggagctccgcttcagttggtaggagaagggcaggactttatggcttgcatcatcggagccatcatgtgtggtctcggattaggggtggtatttaataataacggcagcacgggtggtaccgatatcattgcagccattgttaataaatacaaggatgttactctcggacgaatgatcatgttttgtgatatcatcatcatcagttcatgctatttcatttttaacgactggcgcagagtgatattcggtttcgttaccttgtttatcatcggcttcgttctggactatgtagtcaacagcgcccgtcaatcggtacaattctttatcttttcgaaagattatgccaagattgccgaccgcattacgaaagaaacccatcggggagtgaccgtacttgacggattgggctggtacagccagaataatgtaaaagtattagttgtacttgcctacaaacgtcagtcactcgatattttccgtttagtgaaagatatcgatccgaatgcttttatttcgcagagttcggtaatcggtgtatatggtgaaggattcgaccgcctgaaaataaaataaactgcatacaatgaaacgtaaacttgttttcgcaaccaataatgcacataagctggaagaagtatctgctatcttaggagataaagtcgaactactcagcctgaatgacatcaattgtcatacagatattccggagacagcagagactcttgaaggcaatgcatacctcaaatcatcttttatttaccggaactacggattaaactgctttgccgatgacacgggactggaagttgaatcactgggaggtgctccgggtgtctattcggcccgttatgccggtggagaaggacacaatgcggaagccaacatgttgaaactcctccacgaactggaaggaaaagacaaccgtagagcacaattccgtacggctatttcgctcattctggatgaaaaggagtatctcttcgaaggaatcataaaaggcgaaataatcaaagaaaaaagaggtgattccggattcggatacgatccgatattcgttcctgaaggatacgaccggacctttgccgaattaggtaatgaaattaaaaatcaaatcagtcatcgtgctttggctgtgaacaaactatgtgaatttcttcgttcgatctgatcgataaaacgaaataaataaaatgaatccttcggctgaatataatttcaaaccgaaggatttttttatacttaccgatgtcggcagacggcacttccccacccgctactaatgtgaccaagtatgacatcaaacatcaggagatgaatgggtacatgcaaaatacatagcgaagctgaataaaaatcatttcaatacttcattcatcctgaaacactaagcttacattacaaaaacatccggatgttttatatcataacatggggatcttattcagcaaaacatccccatgttgttactctatactctttactttattcttccggactctatcctttttctctggtcctttatccaatttatccctctttttcctaaagagtaaccgctattcaatggatctttcctgtttaaacactatacacttattattaacagatatttcaaccgatcttgttaataacaaaaaatcgtattatacctttatatataagtataatacgattcttttatatgataaatacattcaatattaaccggaaagttaacttattattcacaacctgtttataagcctaacttagctgaaatctccagcatccgtttaatcggctttaccgcctctctggcaacttccgggtcaacagtcacttccgggaattcgtatttaaggcaattatagagcttttccagcgtgttcagccgcatgaagttacattcattgcatccacaggtactatcgttaggaggagccggaatgaatgttttttgagggcactttttctgcatctcgtgtaagatacctgcctccgtggccacaatgaaccgttgcttgtcactgtttactgcatattttaataaagccgccgtagaacccaccatatcggccaactttaataccacactcttacattcgggatgcgccaatactaccgcatcgggatattgtgctttcagttctacaatcttctccaccgaaaactgttcatgcacatggcaagctccgtcccacaacagcatttcacgtcctgtaatcgaattgatataattccccaagttacgatccgggccgaaaataatcttttcatccctcgggaaactttcaacgatctgttttgcattggtcgaagtcactactacatctgtcaccgctttcacagctgccgttgtattcacatacgaaatcaccgtatatcccggatgtgctttcacaaactcagcaaacttgtccgccggacagctgtctgccaacgaacatcctgcattcaagtcgggcaccagtaccttcttgtccggacaaagcacctttgcggtttctcccatgaaatgaacgccacacatcacaagaatatccgcatcggttttggctgcaatttgagccaaagccaaactgtctccaatgtagtcggcaatatcttgtatttcgcctttctggtaatagtgtcccaagattaccgcattcttttcttttttcagttcattgatggctgctttcagatcaatgcttttgtctacgggttcgtcaacgaatcccttattcacccattcttctcgattcattatattcttattttttctcttcttttaaaaagaaatcctttgttagtgattatagcctgttaatagtgttagcaaataaaccggctttttcttgccggataagttattagttacttatctaagtttataatcagtttatgaacgtgtctatttattgataataagctatattgctaacttcattaacaccttgttgataaagtgcaaagttaaaaactttatggatataaacaggctaattagtactgaaaaatctgttgaagtatgcttggaaagttgaagctaacttttttgtattgttcatatcccgttgctcttataccttcatttgaataatgcaagaattagttttcaaaatatatgctgattcttttgacaggttttaaaccgttatcaacacctatgttaacaagaaaagaattacttttgcaacatactaacagaaacgacatcatcatgcgaaaattgaaaataaccgagctgaaccggataagtatagaagagtttaaagaagctgataaattgcctttagttgtagtgttggacgatatacggagtttgcataatatcggttctgtgtttcgtacggcagatgctttccggattgaatgtatttatctgtgtggaattacggctactcctccccatcccgagatgcataagacagctttgggcgccgagtttacagtggattggaagtatgttaataacgcagttgaaacggttgataacctccggagtgaaggatatgtggtatactctgtcgaacaggcggaagggagtatcatgttggatgagttaacactggaccgttcgaagaaatatgctgtagttatgggaaatgaagtaaaaggagtgcagcaggaggttattgaccattcggatggttgcattgagattccccaatatggcacaaaacattcattgaatgtatcggtaacagcaggaattgtgatgtgggatttatttaaaaagttgaagtagacttggctaaattttaatcctatcaattttaacaggtcactgcgattattgcaacaaccggtcaatgaagctattcctacgtagagaacaattcaaataatactaatttggatactactgtacgacagaaaatcaaggtggttttggtgtaggtataaggctggggtatcaatggtgtagagattgacacatggaatgctataactaccatttccgctaataatgaaatcagggatgtcaatagtgataagaactgagagatagtttggcgaaaggacgggaagccataggaaactaagtattaatattttaaacatgaattcaacaacaaaaactcatacgctgtttttctttgtatttatattctacgccgtatcatgtactgctaaattagggaaacaaacatatacgaatatatatgatttacattttgctatgcggtctgattctgcggtggtttatccgtggcgggagaatggggcatatagtaattatactatccctacttatatacaagattcaaatcgaaatttgttcgctaagaaatattttaaaggatttcctttttctaagcggttaagatcagagtacgaacagagaattttgcttcccaataataacataaaagaagctgtaatcggatttgaaggtaaaggtgataatataaaacttgtctctatcatcttggatgcgataggtaaacaggaaaacattcttttttctgacaccttaagattcaggcctgacagtatattaagcttggttacccaaaacattaatttgactaatgcggagatgttaaacgtacgaattaatgtggaaggagaaattgataaggatgcttatattgctttctctcgattggacatactgattgacggtaagcctattgacgaatttcctgttcgaaccctttctccattgatagtagataaaaaaattaattatacaggtataaatgttgatagaaaaataggattggagcaaataaatgaaatcaatgataaaaagattatcggcttaggggagtcagtccacgggaatgacggtataaaaaatttagcgtatcaattgattatccaggcagtggaaaggttaaattgcaaattagtactgcaggaaatgcccctcgaacaatcatttgcctacaataggtttatacaagatgacaattatgaacttgattcttccttggttatcaaccatgctacaattaattttttaaaaagattgcggagctttaattctggtaaaacgaaagattctaaagttaaattatatggcatggattacaattcacttctttcttctactcaaagttccgctatggatatttttgattttattaccgggctgaaccaaaaatcgcagattccggaagttgatcaattatccctgctgttaatgaaaaaagatcgtaactgtgcgataaactttcttgatattcatcgagataagataaaaaaacttcttactgctgaagaaatagaatgtatcttgcatattctgagggtttcaaagcaagccggagatggcggaatagaaagattcatacggcgggattccattatgttcgtaaatgcaagattcttaattgacaagttcgccaaagacgaaaacgtaaaaacggtaatctacgggcatgcgggacatattaatcctatttcgagttatcctgccgtaccttgtattcctttcgggaggtatatgcgcaaagcgtatggtgaaagttactctcctttgctatttctgatagggagtggagaagccatggcatatgatgaagattataacaggaaagataattggttgagtaggcctcctgaaaacagtatggaatattttttaagttttattaatgacaatgttttttacacccccttaactgtcgattttaatgaattaacactgtctcgacttcaggggagtcaccatatcccacaagaattttatccatttaacttatatcaaagatttaaaggcgtgtttttcataaaaagtacggattgtatccatatggatgaaaaagaaatctcttttgagaaagcttctgataggcttataatgaaaataaaacaaagacaggaaaaaataaaggagatacagaagcggatagaaaatttataaatcaatttagattcattattctaaaatgaagaatagatagcagatttttcctaatagattgacaagtattggtaagagagaactgttttgagtagaatttaagtactgtttttataacgaatttatgtatgatttctacagaatttattattggcatgctcaatggtccgtttgtgcaatttattaatttagtggtatcagcacaatatgttaaaattagtttcttacgcatcaacgaaattcgtcagttggaaaatgaggatgaattactttctattggcaatacaacaattcttccggaaaagattaaagaatatatattttaatacactgctaattctccttataaataccgggaaataaaagattcggctttataaacccagtcgtggagaaataaaaatggacaagatgaatgtaagtcgcattgttcagattgagtggaagataaaagcagcatccttcacagatacaagattaacgaagaatatccaggagcatgtatcagaagtcactgccataacacacttataagataatatgaatttgagaataacctattactcaaagtataggaaatgaatctggaaggatacattacaattgtccgttttctaccaacagtatcactcgttcggttaacttatcttctccttcggggtcatattgttttttcaaactggctccgaaaagagcggcaaatgtctgatagaatcctgctttaaaaggtcccataaatgcttttaccagttcataagaactttgatggctttgccggtctatcagctttatcaacagtttgccttgtgcaaaagagagctttttcattcgtggagtatattgctccttcagtcctttttctacccgtttgatatgacgttggcgggctttttcgttgggcagggtctgtaagtattcgtaagtttcaatgatggtgcggttaatttctctggcaatgggatacactttcttcacgtttctcaccagtttataatattccatctgctcttttctgtttctgaattttaaaggcttgaatatatgaatggtcggaatctggaaagccgggattgtatcaccattatacacacacataggtaccaggtatccaccgagatttgttttttcctgtgccagtgattcggaagaaaacaatacgacgatagataacaccaaaagtcctatggtaagcctcatattcattttgcaaaaataaaggattaaatttatattaatgattttccttgcagcattaacctatttaaattatcttcgacaattcgtttgctatttaaaacacaataatcacactcgatatgaacgaaagcatatctatattgggtatattcctacttgttaatataatgttgataacttctacttgccatgctcagaatcgttcggattatccttgggaagaggtgatggaaaacttgtctatatccgatgaagaaggagatacacgtaattgggagaatgaattggaggaattaaccgatcttgttaacaaccctgttaatataaactctgccaccaaagagcagctacagcggtttccttttcttaatgatgttcagattgagaatttacttgcgtacatttatattcacggatcgatgcagactgtctatgaacttcagttagtggaggagttggatcggcagactattcaatatctgcttccttttgtctgtgtagagcctgttgataagaaagagtctgttacgttaaagcagattttaaaatatggaaaacatgaagtggtgactcgtatggatgtgcctttgtataggcgtaagggatatgagaaaaattacctgggtcctgctgtttataactcggtgaaatacggatttcactatcgggaaaaagtttatgcaggcatagttgccgagaaagatagcggcgaacctttcggagctttacataataagcagggatacgattactactctttctatctactccttcatgatataggaatactgaaaacgggaattgtaggaaactatcggttgaatttcggtcagggactggtattcggacaaggttctatgtttggaaaaacagtttattcttcgtctttcactttcagaaatacagggatacgcagacatgcttctaccgatgaatataattatttccgtgggagtgccatagctttaaaatggaaacaatggacactttctatgttttattcacatcgttcgttggatggagtgataaaagacggtgaaattacctcgatttataaaacaggtttacatcgaagcaaaaaggaagctgataaaatgaatcaattggttatgcagatgggcggaggaaatatcagctataccgggaatagttatcaactgggtataaccggtgtttactactgttttaacaggtcttatgaaccggaacttaaagactattcaaaatacaatctgcatggtcgttctttttataatctgggtatggattataaatatcgttttcatcgtttttctatacaaggagaagctgctttggggatcagtggtatggcttttatgaatcaggtactttattctcctttacaagatatacggttgatgttggttcaccgttattattcacatgattattgggctatgtttgctcattcatttagtgaaggaagtagtgttcagaatgaaaacggatggtatttagctgcttctgtaaatcctttcaatcgctggacgtttttcatttctgccgatctgttttcttttccctggtggaggtaccggataagtaaggcttcgaaaggagtggatctgttctttcaggcagattacgttccgtcgaaaacggttgatatgtatgtgaattaccgttataaacggaaagagcgtgatgtgaccgctacgaagggaaaggtgattctgcctacctatcatcaccggctgcgttatcgtttgaactatttaccctgttcttcgttatctttccggacaacggtagattataaccattttcattcatccgggaaaacggcggggaaaggttatcaactgacgcaaaaggccggatggaaactttcccggttgcctctgacaacagaattgcaaggtagttatttccatacagacgattatgattcacgtatttatatctacgagaaagggttgctgtattctttttatactccctcttttcagggagaaggtattcgactggctattcattttcgctatgatatgaacaagcattggacagcaattgccaagctcggacaaactacgtattttgatcgtgatgaaataggttccggcaacgacctgatcaggggaaataaaaaaacggatatacaaatgcagctgcgtctaaagttttagtaattttgtagaaattcaaaacagtttctaagattaaacagaattaagtatgactattatttttccttctcccatattcggaccggttcattcacgccggttaggggtctcacttggaataaatttacttccttccgacggaaaagtatgttctttcgattgcatttattgtgaatgtggttacaatggcgaacatcgtcctaaatcttcattaccgacccgcgaagaagtccgtatggctctggaagataaattgaaagagatgaaaagtaacggacctgctcccgatgtactgactttcgcgggaaacggtgagccgactgctcatcctcactttccggagattatcaacgatacacttgctttgcgtgatgcttactttccggatgcaaaggtgagtgtgctcagtaatgctacttttatcaaccgtccggctgtattcgatgcgttgaatagggtggataataatattttgaagttggacacggtggatgaagagtatattcggactgtagatcgtccgaacggacgatacgatctgaatggaacagtcggacttttaaaagcttttaaaggtaattgcatcgtgcagactatgtttatgaaaggaaaatataaggggaaagatgtggataatacttctgacaagtatgtacttccctggctgaaagttgtgaaggatatcgccccgagacaggtgatgatttatacgattgatcgggaaactcccgatcaggacttgcaaaaagctactcatgaagagttggaccgtattgtggcccttctcacgaaagagggactttcggcatctgcttcttattgagaattattcttaaatgtatcatttataaaaaaaaatttggatatgatgaaaccaattgctgtcggccaacttagtgataatttctttgaaaccatcagtaaagaatggatgctggtaactgccggtaataaagatgcttttaataccatgactgccaactggggtggtatcggatttctgtggaataaaccggttgtttatgttttcattcgcccggaaagatatacgttcggctttatggagaaaagtgattatttcactctttcttttttaggggaggagaataaaagtattcataaaatatgtggttctaagtcgggacgtgaggtggataagatcaaagagaccggattgaaaccgatgattaccgataaaggcaacgttctgttcgaacaaggaaggttgagtctggaatgccggaaattatatactgatgtgttgcggaaagaaaactttctggatccgtctgtgtatgaacaatggtatactacacatggaggtttgcatcatgtgtatgtggcagagattacaagtgcatggataaaggataaatcttaatagcttaatttatgaaaaacaattgtctgatatgttccttattgtttgcttccggaattcagaatacttggggagctcaaataacagaccgtaaagcgaatcctgataaagcgaaacccaatataattctgattatgtgtgatgatatggggttttctgatttatcgtgttatggcggagaagtacacacacctcatattgattttctggcggaaaacgggatacgtttcagtcaatttaaaaatacgggacgcagttgccccagccgggcggctttgctgacaggtagatatcaacacgaagtgggtatgggctggatgactgctgtggatgaacatcgtccgggatacagaggacagatatcggaccggtatcctacaatcgcagaggtatttcgtgaaaatgggtaccacacttatatgagcggtaaatggcatgttaccgttgaaggagcatttacccaacctaatggaagctatccggttgaacggggatttgaaaaatactacggttgtctttcgggagggggcagctattatactcccaaaccggtattttcgggtttgcagcgcattacggagtttccgaaagactattattataccacagccataactgattctgccgttagttttatccgtcaacatccggctgatgaacctatgttcatgtatttggctcactatgctcctcatctgccccttcaggctccaaaagagagagtagaggcttgtcgggaaaggtataaagcgggatatgacgtattgcgtaaacaacgcttcgaacgtatttgtcgcaatggcttaatcgacactaaaggagaacttccggtatttgaaaaagagtttggaggaaaacggcccgcatggaatagtcttactctgcagcagcaggaacgatggattacggaaatggctacttatgctgccatgattgaaattatggacgatggtatcggagaagtaataaaagccactaaggaaaaaggtatatttgataataccatatttttattcttaagtgataacggtgctaccaatgaaggcgatatgatcacgcagttgcgtgcagatttgagtaatactccatttcgcagttataagcaatggtgttttcagggaggtacaagtgctcctctgattatcatgtacggaggcggacaacctgatggaaaaaagggagcggttcgtcacgaatttacacatattatcgatctgtttcccacttgtctggatatggcttctattgaatatccccgggaatttcgaaatcatgccattgatgctcctggaggcagaacgattcttccggcattgaaaggaaaaaaattatcgaaaagagatttgttttttgaacatcaaacctcctgtggcatcatatccggagactggaagttggttcgggctaatggcaagcagccgtgggaattgtttaacctgttacaagatccgtttgaacagaacgatttatctgcccgttatccggatagagtgaaaacattggaaaaaaagtggaatcaatgggcagaaaaacaacaggtatttccttttgaatacagaccatggactaagcgtatcaattattataaatccctgtatcccgatcaatccggaaaggattgatgatcccaaccgttatttcagaccatgaagatgtgttgaaaacaccgcaaatttcacagattaacatagaaattattattaaatctgtgaaatttgcggtagcaagctatagtaatttttttcttttcagatacatccaatatcccgtgacaggtaatgaagttcctatcagggcagcgataaaagtgatgatctttgaaaatattcccgcataggtgccaaaatgtaaagcacgtactattttccagataggtgctccgcgttttatttccacatcaaagataaaacttacgatgtctctgtaccattgaaatgaccacattaatccggtgagtgcacatactaataagataagtgctgcatataatcccagtacagagtgtaaatcgaacattaaccttcttctgcctttttgatgttctataatcaaccggcttttcttccacttgcgcggccagtatactgtaagtccgctgatcaggataaagatgaaaaaaagggtagagatgcctactatcattttgcctgtcgtccgggtatcatccataagccaccgatgcagcttcatcactatcattaacggactttcgcggatagattcatatcccatcattgccaggagttcctctttgaatacgaggatggcacctgtaaagcaaataatactgatcagaatccctgccggaagggagagccaaagatgaatataacggcaatatctttttatcttcatttaaaaacggtaagagattattgctgagaaattacgtggatcgatctggttgatgtatcctccacgatagtaagaattatatcctaatgcgtcgaacaaattgttcaggtatacacgggcagtaaacttgtggatactataggccaactgggcgtttattgtagtataaccgggcatgtcaaaaggcttttcgttggtcatggaaccgtgtccgtccggtttgattgcaaaatcattcacaggacgtttacctacgaaatagactcctataccggctgatagtctttttaatactcctttgtcaaatcggtattgaatccatccgttagcagtatgtttaggggtattcatcggggctgaaccatttttaaaggccgggctgttttcgtattttgcatccagataagcgtaacccatcattacttggaggttttcaagtatacttccgcttaattcggtttcgataccttttcttttcaggcttcccgctttatcaaaataaccggtaggttgcgtagttcccggatgataagtactataagagaggtttttagtaaggatatcgaaatatgtcagattaaagcgcaggcggttattcagccagtcagacttgatgcctacctcaaattggcgggtattcgacggacctatttcgtctccgttctccattcgtctggccgcatgaaggaggctggtagtggttgtatatgaaccgaacaaattaatgttctttataggagtcaacatgatgcccaacatcggattccaggcatctccggtagtgggacctgcacttgtatcgtcctggctgctgatataactgtacctcagtcccagaatagcttttatatacttattaaaagtcattacctcctgtgccattattccataacttgaagaattggattctaccggagtctcgggaacaaatttaaccgcgacaggtagcacattcgagatgctcggggcaagtacgttgatagtgtctatattgacaggggtataattgctgatcgacagatcggtgtttttgtagtcgaatcccaattggaatgtatgtttaacaggaccggtgaaaatgtctctaccgataaagtcaagctggaaagttgagttgcggtcatcgcgtaatgaacgtgaaattgttcttctacgcatgttatattctttattgaccacggtttttacggaagtacttgtattatccactttatatgaagagccgaagtatgctgcccgcacactgatattatctgtcaactggcgggtgatacgtgcggcataagtcagcgtcttgttgtttacattatcgtttttgaatcccaggaatttgttgtgtggcatgtcgtagagattctcttccgtatctttcgataaattgactgaactggtataaggagtacggttatcattcaggtaatccatttctacggtaacgcttgttttgtcatccggacgccattctaatgaagggttgatgtatactcgattggaatggatgaccgggcgataattatccgaacgttcgaaggcaccgttcatacggaaagcgatcgtctgatttttatccagaacggactgtacgtcgaatgtgggacggaacaatccccagctgcctgcccgcaaagatatttctccttcattggtgaacttgggtgttttggttactacgttgattactccaccggcacttccgaggtcgtttccgataccttgtgtgacggctgcagaacccttgataacctgtacactttctactccctgcatttcggataaagcagagccggtacggaaatcggaatctatccggactccattctttagaataggtactccccggtatccgcggatggacatactttctcttactccgccatacgatccgaaaagagtaactccgggtacattttttgtaacatcgattacggtgagtgctccctgttcggcaatcgatttttctgagattacagaaatactctgtatctgttcactggggcgtaatggcatgcgggtgatggcatccagttttttcggttgtttatatcgttctccgaatacttctacagtcgatagcaaattctcatccggtaaaagtgtaaaagagagctgtgctgcactttttgaggtgagatcgactgtacgggtttgagtggcataccccacaaagctgatatttatcttgtaaattttgcgtgccagactacgcagaataaagcgcccttcactattggttgttgttccgatggtagttccttctatttggacagtggccgaagccaatggcgtatcagtttcgtcatagactactccacggatggtagggactctatcgactgactctggttctgtggcaaaaagtaacgatgggaatattagtaaaactaataaaatcagggtactataaatttgcttcatacattcaacagcattaaattaatattaaaatttagtgagccgcaaaggtacatgtacataaaagtgtgtacaatacctataaaaaggtataatacaatgcagaatccatagaattggtgatttaaaaataaagaaagcggatgaaagtgatcatttagtcacttccatccgcctgttgtgtgcagatagtatcagattattaattcataatttctttggctctgtccaacgctacatttatgttcggacagatattttgttttcccagtaattcatagaaaccggatttctcaagtgtattgtgtactttctcgtttactcccgaaagtacgatagtgatcttttctttttgggacattttacaaaggctggtcaggttatgaataccggttgaatcgataaatggaactttacgcatacgtatgacacgtactttcgggcgatcgcccaactgtgccattgtttcttcaaacttggttgcaatgccgaaaaagtacggaccattaatttcatatacctccactccggtaggtattatcagatgttcttcgcgcaccgcgatgtccagttcgtcattcggatctatttcgtctttgatgacagatatttcggtcgtttccattacacggcgcatgaacaggatgcaggcaatcaccaggcctacttcgatggcgatagtcaggtcgaagatgatggtgaggaaaaaagtgataagcagtactgttacatccgatttgggatttttcagtaatgccttgaaagtgcgccattcgctcatgttataagatacgataaccaatactcctgccagacatgccattgggatgtactgtgccaaaggcatcaggaaaaggaggatcagcaataaaactacagcatggattataccggccaccggtgttttaccgccattattgatgtttgtcattgtacgggcgatggctccggtagcaggaataccgccaaataacggtgtaataaggttggctgttccctgggcaatcagttcggtgttcgaatcgtgcttatcgcccgttacaccatcggctacggttgctgacaataacgattcgattgctcccaaaacggcaatggtaatagctaccggaaacaagtccttgatggcctcccaattgagtgcaggcatggtcgcgtcaggtaattcggatttgattgtaaaacggtcgccaatggtatcgatggtgtcaataccggcgtatgttttcaataaatatactactgccgttactacaatgatggcaataagggaacccggaattttctttgagaaccggggggtaatggcaataatgatgatactggcaatactcacaatagtgttccaccaattgattgtatcgaaatggcggaaataaatcatccatttcccgataaagtctcccggtactttctctccaccaaagtttaatccgaaaatatcagcaatctgtgttgtgaaaatggtgacggctataccgctggtaaaacctacaataatcgggtaaggaataaatttaataattgcgcccaatttaaaaactcccaataagataaggagtatgccggccatcagggtagctacaatcaatcctgcttctccgtattgctggatgatgccataaatgatgacaatgaatgctccggtaggtcctccgatctgtactttgcttcctccgagcagcgagatgatgaaccccgcaataatagccgtgataattcccttttcgggtgatacgcctgatgcgataccaaatgcgatggccagaggcaaggctacgatacctacaatgatacctgccatcaaatcggccataaacgtttctttagagtagttcttcaaggctgagaataaccttggtttgaaatcaaacactttcatttttttctttacttatatataatgtgataaatgtcgttataatccttgttttgcaaagtcgaggttgcaaaattacataaaataaatggtaataagatgtttttgaacatcttatttatttttgatcagttttgtctatattgcaatagatattattaatgaataaaattccgggttttgtgaactaaatccttatatttgcgttgttaatataggcaagtaaccgacaaacgtaattaccaatctaaaatatatcagattatgactaaaagtattaaaggcactcagacagaaaagaatttgctgacatcatttgcaggtgaatcacaggcaagaatgcgttacacttattttgcaagcgtggctaaaaaagaaggttacgaacagattgcagctatctttacagagactgccgatcaggaaaaagaacatgcaaaacgtatgtttaagttccttgaagggggtatggttgaaatcactgcaagttatcctgctggtgttatcggcaacactcttcagaatctgcaggctgccgcagcaggcgaacatgaagaatggtctatggattatcctcattttgcagatgttgcagagcaggaaggtttcccgatgatcgccgctatgtatcgtaatatctctattgcggaaaaaggtcatgaagaaagataccttgctttcgtgaagaacattgaagttgcatctgtatttgccaaagaaggagaagttatatggcagtgccgtaactgtggttatatcgaagcaggtaaggaagctcctgaggtatgtcctgcatgtctgcacccacaagcatatttcgaaattaagaaagaaaattattaatagaatcagactgtattttggagaaaggtggagctgtttaattatggccccaccttttttctatgcattaataatactgtttctttatttaccggcgtgtggatagtcaaccgtgtagtgcagaccacggctttctttacgttccatagccatgcgcataatcagataacctacattaatcatattgcgcagttcacatatttctttagatgccacgctgcgtttgaacaggctttcggtctcttcgtataggatatccaggcggtcccaagcgcgtttcaaccggagatcgctacggacaataccaacataagtgctcataatttgatttacttctttcatactttgagtaataagtaccatttcttccggtgagcgggtaccttcatcattccattccggaatctcttcgttataagaatattggtcaatcaccgataaacaatgtttggcggcagcatctgcgtaaaccactgcttctatcaacgagtttgaggctaaccggttgcctccatgtaaacctgtacacgaacattcgccggcagcgtacaaacgttcaatagaggattgggcgttcaagtctaccttaatacctccacacaggtagtgtgcggatggtgccacgggaatatattctttggtaatgtcgattcctaagctgaggcatttttcgtatatgttaggaaaatgttttttggtttcttcaggatctttgtgtgttacgtccagataaacatggtcgtccccacgatttttcatttcattgtcaatggcacgtgccacgatatcacggggtgccaaagataaacgtggatcatatttttgcatgaattcttttccgtccattgtgcggagcacaccgccatatccacgcattgcttccgtaataaggaaagaaggacggtcgcccggatggtaaagagctgtcggatggaattgtacgaactccatgtcttttacggttcctttagcccggtataccatggcgataccgtctccggtcgctacaagcggattggtagtggtctggtaaacagcccccactccacctgttgccattagtgtcactttggccagatatgtatccactttacctgttcggggatcgagtatataagctccgtagcattttatgtccggtgtctggcgggtgacagttactcctaaatggtgttgtgtcaggatttctatggcaaaatgattttcaattaccgtaatattgggatgttgttgtacagcttgaatcaaactgtcttgaatttcagcgccggtattatctttatggtgtaaaatacgaaattccgaatgaccgccttcccggtgtagatcgaactcccctttttcatttttgtcgaagtttacaccccagctgatcagttcttgtatttgcgcaggagcctcacgcacgactttctctacagcagtacggtcgctgatccagtcaccggcaatcattgtgtcttcaatatgtttctcgaaattgtctaccagcagattggtcactgaggccactcctccttgggcaaaataagtgtttgcttcttccagcccacttttgcaaacaagggcaacttttcctttatgtgccacttttagggcaaaactcattccggcgataccggaaccgattacgaggaaatcgaactttttaaccataagttttagtgtttatcaccgcaaagctacaaaataagttttttcgttgtgcttttcgttgccattaattcataattttactaactttccgccaaaaatctgacaaaatgaaccgtatttttcatgctcgcattgtctggtaccagtattttctgctggttgtattgggcattaatgcttttggtttcttatggtgtaagaatattatattggctactttgatgatgttgtttctgattgttatcatcgaacagatcatacatacagtttataccgttactactgacggtttgctgatacttaactatgggcggtttatccgtaagaaaactattcccatagcagaaattacttcagtccgcaaagtccattctatgaaattcggaaattttgcagtgacaaactatttattgatagaatatggaaatggaaaatatgcttctgtacttccggtgaaagaaaaggaatttatagaactgattgaaaaaacaagaaacttaatttagtaagctatgaaataccaggttattattatcggcgggggacctgccggttacactgctgccgaagctgctggaaaagcaggtttaagcgtgttgctttttgagaaacagaatttaggaggagtttgtttaaacgaagggtgtatacctacaaaaacattgctctattcggcaaagacatatgatggggctaaacatgcttcaaagtatgctgtaacagtttctgaggcttcgtttgatctttcgaagatcattgctcgtaagtcgaaggtagtacgcaagttggttttgggggttaaatcaaaattaacgtctaataatgttactatcataaatggagaagcaacaatcttggacaaaaacaaaatctgctgtggcgaagaaatctatgaatgtgataacttaattctttgcacaggatccgagactttcattcctcctatttccggaatcgatacggtaaattattggacacatcgggaagcattagacaataaggaattgcccgcttcgcttgctatcgtaggtggtggagtgattggtatggagtttgcatcattcttcaacagtctgggtgtgaaagtgaccgtcattgaaatgatggacgagatcttgggaggcatggataaagagctttctgctctgttgcgtgctgactatgccaaacggggcattacatttctgttgagtactaaagttgtctcgttggcacaatcagaggagggagtcttagtttcttatgagaatgcagatggtgccggaaatgtgactgcggagaaattgctaatgagtgtaggtcgccgtccggtaacaaaaggtttcggacttgagaacctgaatcttcaacggacagagcgcggaagtattttagtaaacgggcagatggaaagttcattgcccggagtatatgtatgtggggatttaaccggattttctttattggcacatacggcagttcgtgaagcggaagtagccgtacatgcaattctcggtaaaacagatacaatgagttatcgtgctattcccggtgtagtgtataccaatcctgaaatagccggagtcgggcaaacagaagagtcgcttattgcgaaaggtattgcttatcgtgctgtaaagcttcctatggcatattctggacgttttgttgccgaaaatgaaggggtaaacggtgtatgtaaagtgttgcttggagatgatgatacgattttgggagcacatgtcttaggcaatccggcttctgaaattatcacattagcaggtatggccatagaaatgaaactaaaagcggccgaatggaagaagattgtttttccccatcctactgttgccgaaatattccgtgaagcattgtaagagttacaagttgtaagttacgggttataagtatcatgcgtataatggcgcaattactcgtaacccgtaatttatgacttgtcattcgttgtttataagcattatgaagaaactgaatttatttattttattctctttttgtttttcaattattatccgggggcaggtagatttcgccgcaattgattcacttattaagaaggaattgccccaaggttccgaagttggtatttccgtgtatgatctgactgcaaagaaatcactctatacataccgtgatgccaagctttcgcgtccggcatctaccatgaaactcttaactactataaccgcgcttgcccggccggatgcagatgaacctttccggaccgaagtgtggtataaaggtactatagaacatgatacgctccgcggagacatttatgtgattggcggattcgacccggagtttgacgatgaaggtatgaatgcattggtggaggaagtgataacttttcctttttcagtattgaaagggagaatctatggagatatatcgatgaaagattctctttattggggaagcggttgggcatgggatgatactccctattcttttcagccttatttgtcgccattgatgtatcataaaggtgtagtgaaagtaacggctgtaccgggaacgatacgtggtgactcggcgcgcctgagttttgaaccatcgtcctcttattatactgtgatcaatgaaactgagacacgtactccttctgccggtaagttttctgtttcgagaggatggttagagaataaaaataatcttattgtcagtggaaatgtagagaatagaagaattggtgatgtgaatgtgtattcttcgcaggacttctttctgcatacctttgccgagcgtttacgcaatagggggatagagatttcggagcagtatgctttcgacagctttcagcccgacagcctttctacccgcatggcacgttgggaatgtcccgttcagaaagtagtagaccagattatgaaagaaagtgataacttgagtgcggaagcattactttgccgtttaggagtacaagctacaggcaaaaagcaagtttcggctaaagacgggatcgatgagatccatcggctgattaaagatttggggcatgatccggacaattataaaatagctgatggttgtggattgtcaaattacgattacctctctcctgccctgttggttgattttttgaagtttgcttattcgagaacggatatttttcggaagctctataaagctcttccggttgcaggtattgatggaacacttaagaatcgtatgaaaaaagggtcggcatttaagaatgtacatgccaaaacgggatcttatactgccattaacacattagccggttacctaaagatggctaacggtcatcaggtggcctttgccattatgaaccaaaatgtattgtcggcagccaaagcaaggaattttcaaaataaagtatgcgaaatactggtaaattgtaaatgatgaacgatgaacactttgtagaagtcacagtcggttcatcgttcatcgttcatcgtttatttttcgtattctgcccagttcacgtttttcatatctccgcttttagccagttcggcatgcattcccaaagcggcttgaatggcgtgaggagtctgtgacttattaccggccagtttcagataatcccataagatttgtttgtaatccgggtgtgcacagttttcgatgattgcctgtgctctttccttcggacttttgccacgcaaatcggctactccctgttcggtaataacgatattaacggagtgctcactgtgatccagatgagaaaccatcggaacgatggaactgattttgccttctttagccactgacggacaagtaaagatggaaatataagcattgcgtgtaaaatcgcccgagccgccgataccgttcatcatcttggttccaccgatatgggtagagtttacgttaccataaatatctgcttcaatggcggtattgatagagatgattcctaaacggcggactacttccggactgttagagatttcagacggacggagaatcagtttatcacggaagaagtccatgtcgtcataaatgccttgcagacagtcattggttacggtcagtgagcaggcacttccgaattttacacgaccttcacggattaatccgatcacagagttttggataacttcggtatacatttcgaaagcagggattgttttatcgcgtcccaaggctcctaaaactgcgttggcgatgttacctactcccgattgtaacggaaggaatgtggaaggaataatgccacgtttcatgtcggcagccaggaagtcggccacattctgaccaatcttatcagtaataggatcggcagccgcaaatgaacgggcttcatccggccagtttgtttctacgatacctacaatctttttcgggtcgacttgtatataaggtagtccgacgcggtcactcggtttgtagattggaatttcacgacggtaaggcgggtcgagcggttcgtacacgtcatgcattcccatcatatttttgctatgtgcactgttcaactcaatgatgatctgatcggccagtcggcagacggttggtgcaattccaccggcagctgtcagatagatttttccatccggagtcacttcacaagcttcgatgatagctacattcacttttcccatgaatccgtagcgcacttcttgtgccatttgtgaaaggtgaatgtcattataggcaatctcaccgttattcactgctttacggaaatcgggattggttgtgtaaggggcacgataacggatagcctttacacgtgataatataccatcacatgagtcgccggtagaagctccggtaaagatgccgatctggaaagggtttccttttgcatgttccgcttccgctattttcgctatttcggaagtgacagctttggccgttcctgcgggggtaaaaccgctgaggccgatgttatagccatgttttacaaggctggcagcttctgctgcagaaatggatttgaatgccataattatagtattattttcgtgttaggaataatctttcaatattttctattcagaatttcggaccagataatggcttttcgggcttcttcagccgagcgaatggtaaattccggatcatctgtcggggatgtttccattttcggaggaattgttttatttttcttcacttccgctttcggagggagcggttgggaacggaatgtttgatgttttcgcggtgtttgaaggacttcggcctcttccgtatccggaatgggtacgaaaggtttttgggcagatctttccgttttgctctttttgatctgtctgataagaggtaatgcgaaaacagccataatgacgaggacttttaaaatatcatccatagtacttttattttctacagtccgccaaagttatacatttaatctgattgataccaatattttggcatgaaaaaagggcagcttcacagctccccttaatttttttaacctaaaccttaactatgaaaaaatctaatgtttctttcattgcacaaatgtgtgaaataaaattaatagtgccaaatccttacgccataaatgtttgttctattaacataaattatccttttgcctctgaatcgataagcaaaagtgttattttggtttcatttcacaactttttgaggatgaagctgtatctttgcaggtacaaatttaaattctgaatttatgaacgaattgacgggagcggactttaaatccgcaactgctgatgacaacaagaagttgtttatcgagacttatggctgccagatgaatgtggccgatagtgaagtaattgcctctgtgatgcaaatggccggttattcggttgccgaaacgctggaagaggctgatgcggtatttatgaatacttgttctatccgtgacaatgccgagcagaagattctgaatcgtctggagttctttcattcgatgaagaaaaagaagaagcatctgattgtaggcgtgttgggatgtatggccgagcgagtgaaagatgatttgattgaacatcatcatgtagatcttgtagtggggccggatgcttatttgactcttccggaactgatcgcttctgtggaagcgggtgagaaggcaatgaatgtagaactttcgactacggaaacctatcgggatgtgattccttcacgtatctgcggtaaccatatctccggatttgtatccatcatgcgtggttgcaataacttctgcacctattgtatagtgccttacacccgtggtcgtgaacgcagccgggatgtggaaagtattctgaacgaagtggccgatctggtatcaaaaggttacaaagagattactttgttggggcagaatgtaaactcttatcgttttgagaaggagggaggagaagtggttaccttcccaatgttgcttcgtgtggtagctgaggcggcgccggatgtacgtgtccgtttcacaacttcgcatcccaaagatatgagtgatgaaactttggaggtgattgcacaagtgcctaatgtatgtaaacacattcaccttcccgtgcaaagcggtagctcgcgcattcttaagttgatgaatcgtaaatatacgcgtgaatggtatctggatcgtgtatcggctattaagcgtattgtccccgattgcgggcttactacggatatattctccggtttccactccgagacagaggaagatcatcaggagtcactttcgctgatggaggcttgtggctatgatgcggcatttatgtttaaatattccgagcgtcccggtacttatgcatctaaacatctggaagacaatgttcccgaggaggtaaaagtccgtcgtctgaatgaaataattgctttacagaatcgtttgtctgctgaatccaatacccgctgtgtcggaaagacctatgaagtattggtagaaggtgtttcgaaacgttcgcgcgatcagttgttcggccgtaccgagcagaacagggtggttgtattcgatcgtggtactcaccggataggcgattttgtgaacgtaagaattacggaagccagttctgccacgctgaaaggtgaagaagttttcggataatccgtagttttgcatataaaataaaaggtgtagtcattgagaacgtatggctacaccttgtttgttatatggctacaatgttttatctttgtgcgtaccttagaaaatagaacaccatgaagaacaaactatttattttaattgcactctgcatttcaatccatgttttagcccaagaacctaaaaaggaaattcctttaaaatatggtgccactaacatcggcaagcgtcaggacgaagctatgaagcggtttcgcgacaatcgtttgggagaattcattcactggggactgtatgccattcccggtggcgaatggaaaggtaaagtatataatggagctgccgaatggctcaagtcgtgggctaaagttcctgcttctgaatggttggggctgatgaaacaatggaatccggtaaaatttgatgcacgccaatgggcgagaatggccaaagagatgggagtaaaatacgtcaagataacaacgaaacatcacgaaggattctgtctctggccgagccggtatagtgaatataccgtagcgcagactccatctaagaaagatatcttaggcgagttggtaaaagcctacaatgatgaaggtatcgacgtgcatttctacttttcggtaatggattggagccatccggattatcgttatgagatttcatcgaaagaagatagcgttgctttcagccgttttctcactttcaccgataatcagttgaaggaattggctacccgctatccgacggttaaggacttttggttcgacggcacttgggatgcaagtattaagaagaatggttggtggacagctcatgtagagcagatgttgaagaatcttgtgccgggagtcactgtcaatagccggcttcgtgccgatgattatggcaagagacacttcgatagcaatggctgtcttatgggagattatgaatcggggtacgaacgtcgtcttcctgatccggtggaggacttgcaggtgactaaatgggattgggaagcttgtatgacccttcccgaaaatcagtggggatatcataaggattggtcactgagttatgtcaagactccggtagaagtaatcgaccgtattgtgcatgctgtatcgatgggagggaatatggtagtcaatttcggtcctcaggccgatggtgatttccgttcggaagagaaggagttggctgtagctttgggtaaatggatgaagaagtatggtgagtgtatttatggctgtggctatgccggatgggataaacgagactggggatactatacccgtaaaggtcaagagatttatatggttgtattcaattgtccctattcgggtttccttgatgtaaaggttccgaaaggcacaaaaatagagaaagccgctttaccggacggacaggaactgaaggttgtcgagaccacccggaatgaatataatgtagctatgccttcgctaaatccgggagaaccctttataatcaaattgcaaattaaagaaacttccgctacgacagacaagtaccgggatgcattgacatagtagaatttccttatctgtgcgttcacccgcaaaaaggtgaccaatcattaaaataaaatattatgagaaaactatcttatttaattattgcatgcttatgcctgtgcagtagtatttttcccttgatggcacgacaggttaccgcattcaataccggctggcaatttaagaaaggtccttttgcagccgatccgatgcgggctgcttcacaatgggacggaaagtgggagactgttgagattccacatacctggaatgccaaggatatgcaagttcaatcgggctctttctatgaaggggtgggttactatcggaaaacacagttttttcctcaagatttgaaagataaacgtatatttctgcgtttcgaaggagtaggggcttgttcggaagtatacgtcaatggaaaattggtcggcactcacaagggtggctactctgcttttgcctgtgaaataggtacggtccttcagttcggaacagagaacgagatcgttgttaaagccgacaataaggcccgtcccgacgtaattccggtcaatcagaatcttttcggagtatatggtggtatttaccgtcccgtatggctgattgtaactgagcagaataacattacggttaccgattgtgcctctccgggtgtttatattacccaaaagaatgtttcaaaaaagtcagccgatataactgtgaaggtaaaattggataatgccgggctccaacctgctgctttgactcttgaaaatgctatttatacgcaggatgggcgtaaagtaagtgtacacagccagtcgttcgacctgactccgcaaggaacacagacctatacatctacttttaagatgaaagatccgcacctctggcacggacgcaaagatccctatctctataaggttgtctgcaagctgatggcagatggaaaagtaattgacgaggtggtgcaacctcttggtgtgcgtaaatatgagattgtggccgggaaaggtttttttctgaatggagaaaagtatccgatgtatggcgtaacccgccatcaggactggtggggactgggcagtgcgcttaagaatgaacatcatgacttcgatctggctacaataatggatgtgggggctactactgtccgttttgcccactaccaacagtcagattatctctattcccgttgtgatacactgggactgattatctgggccgaaataccttgtgtaaaccgggtgaccggatacgaagcggaaaatgcccaaagccagcttcgtgaactgatccgtcaaagcttcaatcacccttctatttacgtatgggggcttcataacgaagtatatcagcctcatgaatatacagctgccttgacccaatctcttcatgatcttgctaagacggaagatccggatcgttataccgtttcggtcaatggatacggacatatggaacatccggtcaatttgaatgcggatatacagggtatgaaccgttatttcggttggtacgagaagaagatacaggatatcaagccttgggtagaacaacttgaaaaagaatatccttatcagaagctgatgttgactgaatatggtgccgatgccaacctggcccatcaaaccgaatatttgggtgacgccctcaattggggcaagccgttctatccggaaacattccagactaagacacacgaatatcagtggagtgtcatcaaagaccatccatatatcatcgcttcttatctttggaatatgtttgattttgccgtaccgatgtggacacgtggcggtgttcccgcacgtaatatgaaaggactggttacctttgaccgtaaaataaagaaagactcttatttctggtacaaggccaactggagtgagagtccggttctttatctcacgcaacgtcgtaatgtcgatcgtgaaaaacgaatgattaccgttactgtctattctaatatcgggactcctaaagtatatctgaatggaaaagaactgggcggtattcgcaaaggatataccgatgtgcattacatcttcgataatgtggcacttgctgatgggaaaaatgttctgaaagctgtagccgcaatcaaaggaaaggagtataccgatgaaatcgtatggaactattccggtgagaaaaaccgggaagtagattcttatgagaataagaatgaacattcaggtttttgataatagatttgtcccacgtacccgggcttatgagcccaggtatgcgtgacgagatcatgaaaaggttataaacccttacgggcattataaaatctctttgatatagcgcgtaggcggcactttatagaacttcttgaatcttgctccgaaatatttagcatcgcaaaagcctaaataggttgctatttctgtaacggtgtatttttgtgtaaccagtaaaattttggctttattcattttaaaataatacatgtactctgcaggtgctttatctgtaatatcttttaatttagtatagaatgtagtacggcacattcccatatcggcgcttaacatgtcgaccgtataattgtctgatgagagattcttttccagaagcttatttactttatccataaatagggtgttctcttcactcttcgcagttgtctcagggaggtcggcaggcaaattggtttccagaagctgtttgatacgtttatgcttatttataagtacttgtatatccgctttaagcctgcaaatactgattgcacgtggtgccaatttatctactccacaatggatatgggtgagataactcctattatcattgaagttcatcaggagaatggcgggagtttgaaccatgctggcatttgattttatccgggaataaatttcttttccgcctataccgttcactatttcatcaataatgataatatctggtgttcgctgaccggagaaattggataaacgttccggattattaagaatagttatccggaagagggttgagagggctccatttaagtagctgctcaactcattgtctgacatgactaacagtacgtgtgacctatttttatcagaacggcccatcttgccatcttttatggtaggaatttccacttccggacattggattgtattgcagcaaccgtttatgggaacgataacttgaaaagtaataattcgcctatggcaatccccgattaattttccaccatgtaagcggattatcttctttatgatttgaagattcccacagtggtattataatccgcaaaacgaaatgtttcgacttttgggaacgaaacgttctttttcccaactgaaagatagcttacatgaaaatgataataatgtcctcttaataggtaaactgaagacgaaatgaaaaataatgtgactttctcaacagcgaattatgattatttgtattcgtgtaatcataaagaatgtataccgttacatccaattctgagaagaatcatcaagctggatgaagatggttgtttgggcagtgtgccgaatgatcctgaattgaatggatattctcctgagatgattgcttattatttgcgtaagtacgattatctgaaagcacgtgggattattgcctccaaagacaacgtggaatttgcttcgcttactgcttcttctattcaggaagagttggaaaatttatctgtgcttacatttgaggttactgaccgttgtaatttgcgttgtcgctattgtgcgtatggagatctgtatgaaggatatgacgaaaggaaagggcaagatatggatttcggagtagcgcaaaagatgctggaatatttgtattcgatttgggagaatgccaatcctttgtcttccgtacgtactgttgcaatcgggttttatggaggagaacctttgatgaattttgaactgatacgtcaggtagtggagtatacttcaaagcatccactttccggcatagtatttaagtacaatatgactaccaatgctatgttgctgaataaatatcaggattttctccaaaagcatgactttaaactactgattagtttggatggtacgaaagaggatgattgccataggattactactaatggaaagccttcgtttgagcatgtgtatcgtcaagttaaggttttgaaacagacttatccggattattttcaacatagcgttgtgttcaacagcgtgattcactctaagagcaatatagaacgtattctggatttcttcgaaaaagaattcggacggcaaacgatgttcagcgagttgagtaataaaagtgttgtaaataaagaagtatatgattctatgtatcgtagtgtgattggaagtattgctctgtctgccaggcaaagggagttggatgagaagctaatgtatggttcacctacgatttcttcgttaacttattatctgcatcatttgtctaatgaagtttttaaagattatcgaaccatgttttatggggtgaagaagctatccttgttgcctacggggagttgtattccatttagtcgtaaactttttgtaacagttaccggaaaaatattggcttgcgagcatattagccatgaatttgctttaggacgggtatcggaacagggagtgaagctgaatttagaggagatagcacaaaaatataatgaacagtattattcaaaaataactcctgtctgcaaaaaatgctacatgcaaaagtgctgtgcacaatgcatgttctatacggggattcaagaacagaaagtcgtttgtcgtaactataagaattatgactcttttgctaagtacctggcaaccaatttaaactatatggagcagaatccttgggcgtatgatagagtgatgaaagagatttctttatattaaaaaagatcagtatgaataaacagtatttgtatattgaaccgtatacgcttttttttgagaaagacaaaaaggtgttattgtataataccatggaccagaaatttactttaatagaggttgatggttcgttgagtcctattgtagaaaaacttaaagaacaaaagtgcatagagatactacccagccagttggaaaataagtcaataaaccggtttgtagaggaattgcgtgccggctttaatggtgatattttgcccggttcggcaaatgaggtggctcctgccgtttttcatccggttattaacaatcaacgagattttgaacgtttgaagaaagttaatgcttttgagatagatggacagattatgaattacttggaagaaatttatatttatctgaatggtatggataataataatgatgattttcctgtctatcaacagattccctcttattataataagaagttagagattgatacggaacgtctgatttattggttgaaaactattaatgattttcaggtcagccaaataaacttattaggcggagatgtacttgcacattccgggtttcatcgggtaattaatgtacttcttagtaaagctttagcggtgaatttatattataaatacgacctatttaaagaggaatatatctctttggtaaatgactcgttcaaatctttcttttgggtgattccggtaagggaactaaagagagatttccttgaaaagacgcttgtttggtcacgacaattgccattagttcattggctgtttttaataacttcagaggaagaatattatattgctgaaacatttattgaggagaatggtctggcgcttgctgagatgaagcctgtgtttaccggagataatctttcgttttttcaagatgtggttttcatggatgaagcggatatacaaggtatgggattaattaaacgggaagtatatgtgaaccaaaaagtgaatcgaaacgattttggacgtttgaccgtattgcctacaggggatatatatgcaaatccaaatttcccttatatagggaaaattggtgatgaaagagttcactctatgatatatcgtgaaatgatagaggggcattcctggcttcgtattcgtaaccaagaaccttgttgtagttgtatttatcaatggttctgtccttcaccctctaattatgaactggctattggtaggccgaatctttgtcatataaaatcttgattctctatttagacttgtgaaatatgttatttacatacattggtgatgtagtacatcattaagaccctttattaggtttgagaaatgtacacgtatcaattagatattgtttgttgggggcagtaatttgaatggaaaattggtaattctttgtgagatttcttagtggatagagactgatattgcactgagaaatggattttagtcaatacaaacgatttgccgctgtctgggtacttggggttaatggtacgcttattatgcttatacatagtggcttatgtgacatttcccccgtttatttgtccgggtagataatttgcgaattggctcaacatgatttaactttgaaccaaggagggaggtctcttttgagttatataatttaaaacggttagtcatggataaaatcgagtttggagaaggtaagataacgttttcatataagaaatcgtatggggattgtttgtatcaggatttgattgccgtggaatatggcaagccttattgtatgatacaaatagaaggaagaggtagtattctgtttttaataagtttgcatgatgttctggaaaaattgcctgcaaattttcttctgataaataggggaataatagtaaatatagaacatgttacggatcttgtatgtctggatggagtatatcatgtaaagatggataataataaaatatataggattagcactcgtaaagtggctatactcaaaaggacccttatggcaaaaagtgacacgatccaagtttagtctttagaagaatatatagaagaaaaataccaaaaagttttatatactacgaaaatgcagtatattgtagccgtgaaagtatcatgcagggagatactcgtttctgatatggggcaagtgggatccttatgcacaaacaataaatcttaattcgattgtggctatgaaacacatgttcttattattgatcggtgtatttgtattattgggatgcagttccaataagaagcaagaacctatatccaagtcaggaatacctgtcattaatctttctgaggatgtatcgactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacctatatccaagtcaggaatacctgtcattaatctttctgaggatgtatcgactgtaccttcacttcttttgagtgaggctgcctcaaaggtcgatatagtaccgttagaagtgacggatgaatctctattgggggaaatctatcatcttcaaataaccgagaacgatatatgggtacaccattataaagataaatgtatttgccgtttttcccgttccgggaaatttctgaataaagtcggaaaaataggtcaagggcctggcgaatttattcaattatctgatttttttatagatgagaaacatagagaaatctatattgtatctgcatcaagaggcattttcgtatatgattttgatggtaatttcaagaggcagcctaccagaacaatagtagaaactatgttcggttctatttttaatcaatttatgatatacaataatcacttttttattcttcaaaatttacctttataccgagaaatacctaaagattcgttatggtctcttgccttggttgatagttcttacaagaaaaaaaagatatttaaaaacccagtacatataggtaaagaagatcaaattatagagaatcgtatccagatgaattatatgtttaattattggctggaatcttctactaacatagatacatataataatcaactaactcttaagtttcctgacactgatacaatttatagttatgacagtattaaagaggaattagtgcctcagtatgccatttttgtagacgaagaaaaaggagattacgaatatacacatttatggtttcgtgacaggaaagcttttgattatttttcgatacactcttactactctactaaagaaaatatttatttggtaggcagtaaaggagaggaggtatatatatattgttacaataaacaagaaaagaatgtaaggttgcaaaaacaacaaggagagataaccgagcgtgatgtgccttggtttagtattcctttccgtcgaatggaatgtccgtttgtcctaagcaatgatctatatggcggcgattttattatagattttcgctcttctggtaaatactgggtagatgtattatatcttggcaatgatggaaataggattgatttgaatcaaataaaatcatctactgtaatagatgaatccaagaaaaaggagttaatccaagctctggaaagtgcgactgaggatagcaatccaattttgatgattgcaactttaaaataatagagtaggttcctatgatggaaaaatatgttgtttctaataaataaattgtgatgaagtctatattattattactaataattgcgctattgggatgcagttccaatatgaagcaagagcctatatccaagtcaggaatacctgtcattaatctttctgaggatgtatcgactgtaccttcacttttgctgagtgaatctgctgaaaaactagaaattgttcctttggaaatgacagatcaatctatgttaggtgaaataagacgaatacaagtgacagaacatgatatatggattcatgattttaataaattttatatttatcgtttttcccgaacggggaaatttttgaatagaattggcagtatagggcaagctccaggagaatatgtcaatttttcaacctttctcgttgatgaatataaaaaggaggtctatattatttctaataacaatggtattttggtatataatttcaagggagagtttaaaaagaaaatagttgatcagcagacaatcaataatctattctcatctgtatatagtcaatatatcttatataatggaaatttctttgctgctcagaatatagctttatataaattaatagataaagattcattgtggtcttttgcttttttggacacggcttttcaagaaaaaaaattatttaagaatccagcacatatgggtagagaagagcaaattatagctaactgtgtcgataaaggtagaatgattaatctttggatggaatatcaaaccagtatagacacttacaataatcaactgacccttaaatatccagatactgatacaatttattgctatgacgatgcgacgaatgacctcttgtctcaatatgtaatttgtacaagagaagagaaaggagactatgaggttactcacttatggtttaaagatagaaaggctttcgattatttttcgatcaagtcctactatccgactaaagatttcatttatttggtgggtagtaaaggcgaggaggtatatacctattgctataataaaaaagatggaagtgttagattgcagaagcgacaaagtgcaataaccgagcgtgatgtcccctggtttagctttcctttgcgccaaatgaaacgtgattttgtgttagataatgatttaggtggaggtgattttactgttgacagccgttcttccggtaaatactgggtagatatattagaacccggcggtgatgagaactggattgatatcgaccaaataaaatcatctaccgtaatagatgggtccaagaaaaaggagctaatccgagttttggaaagtgcgactgaggatagcaatccgattttgatgattgcaactttaaaatagaagaattattattttgaatctaaagttttttttcttcggtttggccgtttgagttgaaggaatatattcaagagaagaaagcaaaaggagaagccgtgagtgatcgtcttattgcacttgctgattcactggatgatgagcaaaatctgattcttgtaattgctcatttaaagaaatagctgaatatagagtttgttattgggtcttgtgtgaaaaatattatgtatttttacttctaatttaatgatggacaaagctatgcgaatgatattgatactgggtgttatgatattgggcttcacggcttgtagtaacagaaaaacagtggatcctaatcctgttgttcgggataatattattcatttgtcaactgcgataaagaatgttcgggaggaaatgatgctttcggagctggtggatagtgtcagttatattcctttggaaacgaatccgaattgtatgttaggtaattatcagcgtttgaccttttctccccaatacatattttactcaaactattgttttgattggaatgggcagttcttgttccgtattgggagccaggggcaaggggcttgtgaagatatctatgcgcatgtggctgatatagtgtatttgaataatcatttctatgggaatgcctctaaaataatagaatatgatgaccgggggaagtgtacggggaaagagctaagctggtatgcccagaaaacaatggacactgcgccggttgggcgtatggtcaataaggtctgctttgctccggcaggagaaaacctgatgttttataattctccggatacggtttatttcataaatacggattacgagtttgtagccaaacgcagtatgatgccgtggggcaggaaagggggcgttccgtccatgagtggcggagatcctcgttttaagtacacgagttactataaagatacgaccttattttataatttttatacggatacagtttttactgttgcccccacttccctgatacctcgttgggtggtggagttggatgaagaattacggtttcctacccagtatctatatgaagatggattgttgtctgaagcttttaaatgttgggaatcgggtaatttggaaaacgcaaaaatgataaaactgctggatcacaaatatatagtatccggtgtttttgaaacagagcgttttgtttttttatctgtctatgaatgcatgccattcagggagctgcgtaaactgcctgaggctcctccattaacagccatttacaataaacgtacgggtgagacgtttgccgtgaagcagtttgtagatgatctgggtggtatgaagaccttctctccttcttggggagcgtgtaatgaaaagcttttagctaccatctggccttataagttggaagaatttatagaagaggaacagtctgccggacggactgtggctccgcaaatactgaacctgatgcagcgcgtgcgagaagatgataatccggttcttataatagctcatttgaaaaaatagctttgtctgtttgtcgaaatatagaatgttggattgttgttttaaatataaattggtatgaataaagttcgattggccttgtatttgggtatattgacgcatctgatcggttgctcttcttcccgttcagagaagattgatttgttagctcaggtgccatctgattgtccgattgttgagatgaccagtgttttagatagagaggactccatctcagtgaaggaattggtagatagcatttcgtatgtccagttggataattttgtgaaattgccggttcgtgccagtatactcagtatggcggtaactaaagattatattttcgtattggccggtagtgatgcgggagtttttaaatacgataggaaaggaaagcttataaagaagattatatccaacgattattcgtctttaaaattatggattggagttgatgaattcaaggaattgctttatctgaatcaggaaggcggttcagagggcactacagaagtctatgattatgatggtaactatcaaggaaatattgctgaattgtataatatgccatatcattctcaatatgtacatcgactgaatgaaaaattcctggctgctttttcaccatggtgtatgccattgactgataagaattattttggcggagccgtattttcagaaaagggggaaatggtacatcagttgaattattttgttccgtctgacactttgggtttgtgtaaggttagctattatagtttcacttatcaatcagatgggagtatgttggtttggaataatgggggaagtggtagcccaattgttcagccttataccactttgtataaggtaactgtcgattctatttttccggtgtatcgtttgtttaatggtaatacacgcgataaaatagatcatgttcaaggaattggggtcagcggcaactctttggccatagaaacagactccagtctctatttatgttgttatcatccaaaggctccacatccgtgcccgaccttatgttttatgcgatatgatataaaaaataaggttcttcaaggagtcaattatcctcctaatggtatttcaggaggctatgtaaatcatttgaaaggtgatatcccaatccgtttccagtattcgtttcctcttcaaagggtatatgtttcgagtattaattctggcgaaatagagcaattgcgaaagtcggggtatatcgatgcaaatagtgatgaaacattaaggagtaataaacctggagataatcccattttgatatattatcattattaatcatttaaagttctcggtattatgaaatcacttttatttttttgtttaagtacatttctcttttattcgtgtagtaagaaagagaatagtctttatcctataatagacttagccgatgctatcgaaaatccggtggagaaatctgtatatgatattgcggaaagtgtagaggttgtacaattagagacgaatgattcgttactgattccatacgtgagccagttaataatgaccgatcagtattttatcataggatatggtaagaagtgctctcttttttctcattccggaaaatttgtttgtgatatagctcagaaaggaagtggtccggaggaatatacaatgttgatgaatttgctttatataaacaatcgtgttttgattacagacttaaataataaagttaatgtttactccttgaatgggaagtttattgaatcttatcaggcgcttccagacatgttttctgccatttatccaatgtcggacaagaactttataggctttaaagctcagagtggaggagatgaaaaagaacgtcttgtgttctatcgacgggatgaaaagaggggggctattccatatcaacaaaactatcaggcaaaaaaagtttgtttcttccctcatgaagcccaattttcatctttatatgataagttgtactttaagcagttgcttaatgacactattttctctgtggatacggtaaagcattctctttctcccgaatatataatcgactggggaaagctgagatctaacgatagattgcgctactctttggaaaatccggacgaagaattgtttttatacatgccatacgttcctttgttcagtatgactgctgatggattagtcttaggggctattacagtagacatagatcagaagaagcaatattacttaactgcattctatgataaggcaaatcataaggcggatcttttcgaactaaaattatcaaaaaaagagatggattattttggtgaacctacaggtgagcttcctccttatctggagggtgatacttttttcccggagtatatttcccaagatggcaattatttgatttctgtcagaactcaacctttaaaagaagaattgaatcctgcgttgattgtagtgaagctgaaataatgaatatggcctgacactgatagatttctgatttttatataagtattagtagctgtggaactaatagcctgttatttgggacaggctattgcgcattaatgtctctattggtgcttgagggatgtttagctcgtgtaacaggctaagaaccaggtaaacttcgcataatacaagccgattatttgtatccggaagcaactctgctatccaatttatcaggtgaaagagatattcttttatttttaaagctgtgggagtgttgaagttttctcttgcacatagacgtaaatagaaatagtaagctaagcccgaaactccctttcttaatccgaggtcagtcaaagacttttgttcaatgactgaatatacagcggagtctatttgatgtagtatttcatcactattgccttcgaccagtttcttttgcagtaaatattcgattcccgctccaatgccacataacccattctcgtaagtgataggaacagccagagagcagtggtctattatcttgtttagtaaatgatctgctgccttctctaattctgtatcgttcgttttttggcttaattgaaaaagctcaatcgttcgttccatccaccttgataaaagtcgatctttgattttgttcatagaactattgtatttgcaatatagctcttttaatacttgccaagtgtactcttgatgccatggctttatacttccggtataatgaatgatgatgatgccggataacatttcaggggtatgcaaagtttcactggtagtgaaattatagatattgggaattagctttattttgcctttacatatacagttaatcgcatcttgatcctgatatcgatcccggtttatatagattgatgtgtgttgcaatagcttttcctgtattttatcttttctaaggtctttcagattcaacagcagtacgcctgcattgatgtatacatccttttctgttagttccagtatctttctataattgattcgtcttataaagatatcatccactcctgcacaataataaccttccaaatccagttcccacaatggctctatgctgccattgattactaaatctgcatccaggtatagggctttatccagattgggaaaaagatctgcgatggcataacgataaagagtgtgttcggtgatgtatcctccttttttcttgagttgcttgaatgattctgaatctattatctcccattggatagttacacaggtaaatacattttctatttcctgaaggagctctttgctttctaacgaaatacaatctgtcagaatgtatatgcttatattcaaagatctattattctcaagaatagatactatagaggtacagcaatggtcaatgtattcttcattgattgcaaagaagattggtattgtgtttttcatgcttgtgtggttaaaaaggattatttgtcagagacaaaggtatcagttttttagatatatttctgtttacaaggattatttctataggtatatgacgttcggtataaaaaaaggctacgttcggtacattttttctgataatatttggatatgaagtaaggtgggcataccttgcaaacaaatctaataaagatatggattcacaactacaacaaatagctcaatactatatgcttcatggaagattccttccaagtttgggactttttgatggcaagatgggacttgtcttgtttttctttcattatagccgttatatacaaaaccctttatatgaggaatttgctggtgaattattggatgaggtttttgaggagctatcaatggatttttctataacttggaatagaggattggttgggattgcgtgggggattatatatttgcatcagcagaaatttgtagaaggagacttgctttatgtactacatgatgttaatgagaagataatggagcgtgatatacgtcgtataaagaatctgtcttttggaacaggacttaagggtatattgttttatgtaaatttttgtataaataatgggttagctgtatttttcgattcaatgtatttgagtgatttgcaatccgtaattgagaagaataggctcttttatgaagaaatttatactgaggatattataaggcgtagtatgtctaatcctttattaagagaggggttatgttatatgttgaaagatgattgtaatgttaggtatgaaacatctttatgtaataaataatagtaatgcgcaatacggcgtaaatacatatattcgtcagttgcttgaagtctttaagggtggggtaggctgtttgataacattggttaattggggctcaactgtatctgaggtaactgttggatataaaaatggtatacgttttataaacataccatatgttcatccaaaagtgtatgtaaaagaggaaaaaatatatcaatcagttggttatataattttgagttatttaaattatgatgaatataatgtatttcattataattacttttctgattataacttggctgtatttataaagagtagggtatccaatagtcgtcatattttgactgttcattacttgagatggggaacattattaaatggtaatgtggagtattatcgttctattctatctaaaaaggtaaggagtaaatttgagcaagatatatatgaagaatatattaaagagcgcgttttttgtgatattgtagattgtgtaatttgtttgtctgaatttacttctaggttattaaaggaagactatgaaatttctcctaagaaggtggtactaatatataatgctattaaaatgatagatgatgacaaaccatgtgaatttttgtttaaatctaaaaataagattattctttatgtgggtagaatagaggagaataaaggaattacttttttgatagcggcctttaagcgtgttcttaagagtgtacctgattcctatttggttataataggtgatgggaattatgatattgtgtaccgtgaaattataaatatatgggatcatgtgatattgacaggtaaactgtctcagaagctcttgtgtaggttctatgagattgcggatgttggggttctaccatctttaaatgagcagtgtagttatgctattattgagatgcttttgcatggtttaaatgtgataactactaatgctttaggcctaagcgagatggttgaaaaggagaatcgggtggatattcattattacaagcagggtatcgcatttccaatcgatgttttagctgaaaagattttgaacaatattttgttctctcataaagagaagataaaggaaaatgttatttattcatttgattctttcagagcaaaaatgattgatctttatttaaatatatagttatgtataatatattttctgaatttttgaaagagcttaatgtagcgtttgttacttcatatgcgaatgattattataataatcatccttataaaaacactttgtatggtatatcagatttattatataaatataatattccaaatgttggagtcaaagttgataattgtgaatcacttagtctttgtacgccatttatagctcatatagaggatgattttattatagttaaagagatttcatttggtgacataaaatatatttgggaaggtaaaaagtatataatgtctgtaaatgaatttatgaaaatatggtctggggttattctgttagcggaacctgattcaaattctcaagagcctgactatacgaagcatatgtttgataatttgttccaaatgtctaaaaaaataggattgtttttgttcgctttaattaatcttgtttttgtgttaaatattgttattgataaagttgttatctgtctgatttttttaaattttattggtgggtatattagttaccttctattactaaaacagagtaagattgattcaaaagtggcagatagtatgtgttctatgttgaataaacatgattgtaataatgttttaaatactcaggctgccaatttattctcatttagttggagtgaaattggttttagttattttgttgttaatttgattatattattgtactttcctgtatatgtcaattatgttgcatgggtgaacgttgtaatacttccctattcgttttggagcatttggtatcagtataaagttgtgcatcagtggtgtgtgttatgtctgatagtacaattgttaatttagagcattttccttgtaaatttattaagtgggaatatattcttagtgcatattgctggaatgcagatattacatttagggtcgatttacatttttgtccttttattgacaaatcttttgttgttttatttgtctgattattgtgttttgaaacatatgcttcaaggttataatagtataaaaagtaatgatgatgtatttaagatcttaagatataagcaaaagcattttaatgtggataaatgtacttctaaaattatgtttggaaattctaaggcttctaagactataacccttcttataaacccacattgttcaccatgtgccaagatgcatcaacgaattcaaagagtcttaaatttgttgggtgataaagcttgcatccaatatgttttttcttcttttaatgatgaattattatttagtaatcgtttcttaattgcaacttatttccagaagagtaaatctgaagtggaaagtatttacaataaatggtttgaatggggacggtttaatcctcaagatttttgtgtgaaatataacttggatttaaacacattagaggtagagacagaattagagaaccatgagttatggaaaactgaaaataaattgcaagagactcctttggttttgcttgaggggtatactttaccagaacaatatgatgtggaagatttgatttatttaatagatattgattgatatatattactaaattgtggggtaatataaacaatgattgcgcttaatcattgttagaggtccactttataattgaattaactaatattttctcaaatgaaaacattgaaaaagatttctttgaaggatgtgaaagttctagattctgatgaaatgaaaaatgttttagggcatggtactggttgtgaaggtctgacaaaatctaaatgtagtggatcttgtactgttgatggagggcatccaggtaaatgtggctggacttctgcttggaatagatgtacatgcgcatctgcttatgcgggataactttttgatttttatttaaggaatctctaagtctgctggaatattttaaatatctctagcagactttaataataaagtatgagaatttttatgaagtctatagttgctattttaatatttgtgttatgttcttgtggagagaatattgttgttaatatgaaaattaatgttggggaaaagatgggggattttgagaatatttcagtgcaaacaatatcttctaatatagaatatataccattagaaacgagtgatagttctcttattggggcgatgcctaatatttgtgtactaaatgatgctattcttgtttcttccgcaaaccaatgtttaaaactttttgatagacttactggtagatttattcgagatatagggcatgttggagtagacccagaaggatatgcaaaagattcttggggaatagttaattattgggttgattatacgcataatttgatttatgttttaggttggaataatgatttggtaatttttgatttgttaggtaattgtaaagatagactccagatttatgatgatacacgttataatttgtctcagagttatttgtttatagatagtggaagaatctgggggcacaataaattatacatttctaatctctgttcttctttattttttgtggagcagaatactaaatcaattaatgatataataggattatctatacttccactccctatggatgaaatacagtctatatccaatcttttagggaattatgtctcttatgggggaaatctaacaatggcctcatttacagatgatagaaaattctacacttctattgatagtccttctttatggaagaatggggataagatttgtttaaaacaagcatttaatgatacaatttatacattatgtgatgataggatatatccctacttaatctttgaattgggagattggaagtggaattataaagatagattggaagtgccaggatgtgagagaaaaatttctattgattatgttcttgaaaacgaaaagtacatttatttccattttcatacaggattatatttgaataatagacaatcatattgtggactttatcagaaagaaagtaatagggttactttgatgcgaggtgatagaatctttgatgtcattaataatcaagatattcagcttagaactattacttctgatggctgttttgtggctcttttgcaaccgaatgaattgtgtgatgaattaaaagataaatataattgtaaagaggacgataatcctataatagtaatattaagaaaatagtgcaataattatgtaagtgtataatggagtgaatattttatatgcttatttgggtaattgtttgttgtttagttaataatgtatcttttatatttctttcgattgaatactatagattgtactcctttctgctttgttataatgaggtattataataaaagtgtttttctgccaatctttcgtttatgctcttttctttattgggttgctgatgaatatgggaatatatggctttatagattcttctggaggaatagaaagagagattttattatcggttggcaaaaagtcagctggagttaggaactttataagggggtagatatgcaggctattatattggcagcaggaatgggtaggcgtctgggagaattgacccggtacgacactaaatgtatgattgaggtgaacggtatccggatcatagatcggttactggcaaacctggcagtcgcaagactatcgaggattgtgcttgtgattggttttcaaggtgacaaactacgggcgtatctgggaaatgaatattgcggaattcctatttattatctggaaaatccttactatgcatataccaataatatttattctctgtttctggcgcggcatcacttagcgtctgatgatactttattgttagaatcggatattgtttttgagaagagaatacttgaaagagtgctcgaagaaccgtatccggatgtagcagtagtagaccgttataagagttggatggacgggactatggtgactgtggatgaaaagcagtttattgtggactttgtatctaaacatactttttcgtacgaaaaaactcctacttattttaagacggtgaatatctatcgttttagtaaggagttttctgtaggtaagtacgtaccttttctggaagcctattgcaaatgttttgataatagtgcatattacgaacaaatactggccgttttgtctttgttggataaagccgggctgaaggctttgccgcttgagggtgaaaagtggtatgagatagacgacatgcaggatttagatattgccgaaacgctatttggtaagaaagaagggcttttgcccggttaccagaaacgttatggagggtattggcgcttccctttcttgtttgattttgcttatctggtgaatccacatttcccgacagaaaggatgctggaagaactgaaggctaattttgataaactgctcaggcaatacccttcggggagttatgtaaacaggcgattggtggcgaagcactggagcattcctgcggaggctgtcgcggtggggaatggcgcagcagagttgataagaaagctgatggagttgctttccggtagaatgggggtgattcttcctacatttgaagaatatctggtgcgtgatgaccggatagagactttcttgccgttgggggccggttatcgctataccgtaagcgacctgaaaacattttttgaggataagggagtgacttcattactgttgctgaatccggataacccttccggaaatagtattccttacgaggatttgatttcattagcgggatggactcaggagcgttcgatacggctgattgtggatgagtcttttatcgacttctcggagggaggagaagaaacttctctgattgatgacaagatactgaaggagtataatcatctggtggtgataaagagcctgtctaagtcacatggaattcccggattacgattgggaattgctgtttccggtgaccataaattaatggatgaattacagcagaaacttccggtctggaatataaactctttggcggagtactatttacagattctggataaatacacaatcgactaccgccaggcatgtgcccgctttatagaggaaagagcgctcttttttgaagaacttcaggaggtaggctatttagcggtatttccttcacaagcaaacttctttttatgtgaagtgacccataagtacagcgcccgagagcttgcggaagttttgctgagagagcatgatattctggtaaaagactgtagcttgaagaggggaatgtatggaaagcagtatattcgtattgctatcaggagtaaagaggaaaaccggtatttggccggaatattaaaatataaattatgaatatagatataaaggaggcacatcggaggatgctttatttattgcagtctttcgatactgtttgcaagaagcacgatattgattattggctcgattatggtacactgctgggagctatccggcatcaggggtttattccttgggatacagatacggatgtggggatgttaaggagtgattatggagtatttctggagaaaggtgtgccggaactgcctcaggatattttctttcagactccggaaacagaaccggccatggctccatggagctggttggttgaggcgcggttgagagatcggcacagccggtatgttccggataaaaagactccggccgagccgatgcagttcggtggattacagttggatcttttcatctatgattgggatggtaagtatgagaatgctttgtcgaacagttttgaacggaatttgagtgagagccgtattcatttgcggctggatgaggtggaatatctggatactgcacgatttgaaggagtggagtttccggttccgtcaggatacgatacttatctgacccgttgttatggagattatagaacgtttcccccggaggaggaaaggcaaattccggaagtggttgcctggtcggtgtaataaaatgattgattacgtcaataaagaaaatatggaaagcgtaagagggatagaaaatccggggatgatgggagaaatggggaaaatcatcggattctatcgtctttatcggcagacggctgaagaagagtgggaagagaaagcagaagtgttgctggatgaggtgatggagaattgttctttggaacttccggtgacttatggtgacggtttgtgcggagtaggtgtcggaattgagtatctgttgcaggagggttttgtggaaggggatgccgacgagattctgtggcagatcgattgcagggtatttaacacgattaatagtagggcgatcggaactttaggcatcgggaaaggtatttgtggtcttgcttattatctgtattaccggttgtcccggaggaaaggtgaggaagacatcaaggtgctgcgaatgaaagagcatttaatttacctgattgactggatagcagactcactgcccggagtcagggaaagttcacttttcgaagaggtgttttttattctttgcttgttgcatcggttggatgtattcaatgcaaaagtcgagaaactgatggagtactgtgagaagggcatgattacatctggaagggaggcggtatggatctgacaagagaggttagcattgtcatccccttgcgggtagataatccggagagggcggagaatcttcggtttatcctttctttgctgctacagcagacagaggtgtctgtggatattcttgaggcggatacggagcaacgtttttatttgtctgagacgtgtgagaggttacgctatcggtttgtgaaagatgatgatccggtgttctaccggacacgttatttaaatatattgttgcgatcggctaagttcccgattgcaggtatctgggatacggatgtgattattccgccggttcagttgagagaagcggtcggcaggatttgttcgggctgtgtgatgtgtttcccgtatgacgggcgttttatctttctgaatgaagctatgagtgatagaatccgcaaggacgtatcagtgttggaaaaggtggatgctacttcaatagggatgagaccttcggtgggaggagcttttcttgtgaacagggttgcctatctgcgggcaggcggagagaatgaagcgttttatggttggggtcccgaagatgccgaaagagtaaaacgcctggaaatattagagttgcccattgcgcgtgtaaaaggaccgttatatcatcttcatcatccgaggggcatcaattcgggttttgatatgggtgaacgggataaacgtaatttagaagcattgttagctacttgcagaaggagtaaggcggagatgctaaggtggcttggacaaccaacctttccggactgactatactaagtttatatgatatttgattgtcggatttataatggggaataaaaatagattgattttaagtgatttttcaaattgaagaagtatctttgtatatacacttccctaaaaacaatattaaagagacaatcattatgaaaaacacaatattattgttgaacagcttgtggctgttcgggttggtagcttgccagccgaaacctgtcgcttctttatccgaatgtccggttgtcaatatccgctctgctttgcaagaagaggctccgatctccatgaaggaagatgtggagagtatagaatacgttcctttggaaacgactgattcatgtctgataagtaatctgatgaatctacaggtgacggcagattacatgtttatgtataatggaaagactgaagaggtgctgcaattcaatcgggaaggtaaatttatacgcaagatcggctgtcagggaaacggtccgggagagtatggcatgataagtgatctggcggttgatgacaggaataaggaactgtctttatttcagtatggaggagatgctttggtttattcgtatgacggaacttttctacgaaatgatacaactgtgaaacaagcaggcgggatgtatgtttttccggatggaaaaagggcattgaaaggattggttataaaaccttttcagcaggcgccatgggcaggagcattacaacaacccaatggttcgttacaagagtgtaaggcccttttcccatcggggctttcccgggatgtttgctttatgaaagaaatctgtttctctccttcggacgaaagggtattagtatttactgcctgcaatgatacggtatctgcgatttctaataatggaatagaaccggcttatgtgctgaagagagaaaatccggttgaatattatatggacattgccaatattaataagtttggagataagacagtcgaaacggatcaggtcattgggctttacgatctgtttgaatcttctcattatctttatttacgcttgtataaaggagatgtgttgtttatacaacgatttgataaaaagaccggtgaattgaaatcacaacgcattccgaaagattatttggaatgcagcaatagtattccgggtagtaatataattggcattgataatgatatagatgggggaatacctttttggccggagtatgcacaggctgacggggaacgtgcacaggtggtcaatgcggatatactttcttctttacgggagaaaggatacctgaaagaggctcctgctgcgctgaatgtaggggatgatgccaatccggtagtgattctttataaatttaaaaaataggaggtcccatgaaatcgtttacattttgtattttattggcccatgtattggcatttccgctttttgcccagaaaaatgcagccataacactgaatctggcgaaagccattacgcagagccctaaaacggtaatgctgagtgaactggcatctgatgtgcgttatttccctttagagacaactgataattgtctgttgggtaatgagtgcagtattgtttatgccggaaattctattattgcaggtgatgcacagaccagaagtttttatcgatttgataaaaatggtaagtttatgaataagataggtcagcatggacaagggcctgaagaatatgcggtaggattgttgttttttactgatcctgataaccaaaagctgtatgttcaggattttcaggatttaatctgttatgacttcaatggcaaatttatccgtcgtataccggctcctcatttgaatatgggtaccggagctgtaagtagcggagaatccatcttatattgtgataataactatttcataaggaaggataatcctcaacaactgtttcttattgacgggaatggtaagaagctgaaaagctggaaagggtatattgaaccgggcaaaaagtatggtattaacttgtccacccgtgacgtaatgtatcttcatggtggcagtgtttattttaaaccggcactggagaatctggtttacaagattgatgccgatcgaaagaagactttggcttggaagcttgattgttcgggtaaagatgtggatgtctcggccaatgagatagatcccgcaaaacgttttaagtctatcgcagtacaacaggtttttgaaaccgaccattatttttttatattatatgtgtttaaaaatgagggattcgtggggttgtatgataaacaaaagaagagcttttcgaatgtgattataaaagatgacttggcagcaggctttgattttactcctcccggaacagggttgggaaatcagttggcaaatgcccggatggtaggttatctgagtaaaggtaaacgctattcgaaagctttactgccggaaagaaaaaaagaactggatgaattgataaaccgattggatgaagaggataatccggtaatggttgttgtaacattaaaataaaatctatataaattctttttaaacgtatgaaaattacaagttatgtttcttttttatattgcttatgtgtgatgctggcgagtccgacagtacaggcgagcgaagtgcgaaccgctatttttgaggggaaaccgtgtattaatccccctcatgtggtgggaaactatcctgctaccccttttttgttttatattcccacctccggagaacgaccgataaagtggcatgctgaaaatcttcccgaaggattgaagctggataaaaaaacagggattatcaaaggggaagtagctgagaaaggaacatataaagtggtgctgaaagcagaaaatgccctcggatctgatacacgggagttattgattaagataggtgatgagttactgttgactcccccaatgggatggaacagctggaatacattcggacgtcatctgacagaggaattggtgttgcaaactgcggatgcaatggtagagaatggaatgcgtgacttgggatatgcctatataaacattgatgacttttggcaattgcctgaaagaggggcagacggacatatccaagttgataaaacaaagtttccaaggggcatcagatatgtagctgactatttgcatgaacggggattcaagcttggaatttattcggatgccgcggacaaaacctgtggtggggtttgtggcagttacgggtatgaagaaacggatgcacgggattttgcttcctggggtgtcgatcttttaaaatatgactactgcaatgcgcctgccggacgggtagaggcgatggaaagatatgaaaaaatggggaaggcactccgggtgaccggacgttctatggtattctctgtttgtgaatggggacagcgtgaaccctggaaatgggcaaagaaagtgggcggacatctttggcgtgtatccggtgatatcggtgatttatggaatcggtctacagatcagaaaggcggccttcgtggagttctgaatattttagagataaatgctccgcttaatgaatatgcggggcctgccggatggaatgatccggatatgcttgttgtgtggattgacggaaagagtaagagcatcggttatgaatcggaaggttgtacgaacgagcagtatcagtcacattttgctttgtggtgcatgatggcttctccgctactctgtggcaatgatgtacggcagatgaatgacagtacgctgcagattcttctgaataaagatttgattgctatcaaccaggatccgttgggtattcaggcggaacgtgccattcgtgccgatcattatgatatctgggtaaagccgttgagtgacggaagtaaagcgatagcctgcctgaaccggatatccggtccggtggatgtggagctgaatgaaaagacggtggaaggattgtcgttggacaaggtttataatgtcatggaaggtggaattgttcctgatacttctaccggatggatagtaaagcttgctcccggtgaatgtaaggtatttatatgcagataggtaataaaatgggctatccggtaaaattggcggtaccggacagccctctcttcatagccaggtctatattggatcgattattttaaccgtatggcaggacctaccctgtaagtattttcccattgtcgggtggcagcattgtagcttctgtcggtgccgagattaaggtcgatgccatactctttcttttccagaaggtttatacggaacaaagcgccgtaatgagattgtggagataatgggaaaccttgtacgccggagttgggagtgcagtttagcctgtattgtccgtaaacataagcggtcaaccaattattgaggcgataggtaaggtccgcattcagtgtgaagtcattgaacatccgcccgttggaacggtattgataagcattaccgcctatccgaatagtcagttgtttgttgaggtgatataccaatctgccacctgccatattttgagttcctactccccggagtgaataactggagccgtataattcatatccgaaataatgggaattgagcagccggtgttgctcttgattgaaataactggtgaagacaggatccagataggagaatctttttcttagttcatattgttcggctaatggcaggctgttgctgaaaaccggattcgtttctgacagagtactctttatgtcgggaagtccggagattttggggaacttcatttctttttgtggcataaaggggagtataggcgtttcattgaacgtttgtgcgtaagcaagtccgttactacaaataatcaatagtattgtcaatctgaatttctgcatagttaagttttttatgttttttagacgcagagatatgctgaatgctgcaatgttttttcaaaagaatcatttatctttgccgaaatacgttaaaagtcgaatatggaactggaacttcaacaacttactactgaggtgcgccggatagcaaccgaagcggggaattttctgagaaaagaacggcagagctttagccgggaaagcgtagtagagaagcatgcgcatgattatgtatcatatgtcgataaggaatctgagaggctgttagtggggcaactgtctgctctgttgcccgaggccgggtttattgccgaggaaggttctggtgtttataaagatgaggcatattgctgggtaattgatccgctggacggaacaactaattatattcatgacaatgctccatattgtgtcagtattgccctccggagtcgtacggagctacttttaggtgtagtatacgaagtttgcagggatgagtgtttttatgcctggaagggtggaaaggcttggatgaacggagaagagttgcatgtttcgaaagtggggaacattgaagaggcgtttgtaataaccgaacttccctataatcatcaacagtataaacggacggcagaatatctgctgaagcaattgtatggggtggtagggggcattcggatgaatggttcggctgcatcggctctttgttatgtggctgccggacgttttgatgcctgggcagaagcatttatcgggaaatgggattattcggctgcggcgttgattgtattggaagcgggtggaaaagtaactgacttttatggaagtgaacatttcatagaagggcatcatataattgctactaacggtcctttgcatgctgtctttcagcagttgctggaagaagttcctccgttggatatgtagtttcggacattgatcaaatagaaaaacacatcatgaatacctggttccattctttctggtctcttttgtttccgcgttgttgcgtagtctgtggttcgccattgtcaagaggggaggagtgtttgtgcacctgttgcaatataaatttaccccgtaccggatttcatttgcggaaagataatccggtagagtgtcttttctggggacgtattcctggcctaaaaagagcttcttcttttcttttttatcgtaagggtagtgatttcagacgcatcctgcatctgctgaaatatggcggatataaagaattgggagaggtgatgggacgctatatggcagcagaactatcttcgggagaattttttgatggcgtggatatgataattcctgtacctttgcacagaaagaaacagaaacttagaggatacaatcaaagtgaatggattgcccgtgggatagcttctgtaacgggtattccattatgtgcagagtgtatgatacgtgaaaaaaatacggaaactcagacccgtaagtctacttttgaacgttgggagaatgtagaaggaatcttcaggctatgtgatactgttcattttgaggggaagcatgttttgcttgttgatgacgtgttaactaccggagccacgactgtggcttgtgcatctgcgttcgcaagggtgagcggaatacgtatcagtgtgttgacgctggcagtagctgagtaaatggagtgatgagttaatagagggtacattaaagcaccctcatattcatttagaaagtttcaattatcaggtcggatgccaacattcctttgatcgcttctccaaaagtctggaaatggggtgatgctgcatgtacatccatagcatgctggtctttgtactcttcgtaaaagatgaaagctacaggttgagaggggttttgatacaggttatagctaatgttgccttcttctgcccttgtacctttaatcaaagcatcggctgcctgtaaaaatgcttgttctttgccggggagcacttctacgcgtgccacgattgttttcttttccatatgatattttataattaagatgattcttgttccgcaaatttacgtataaatggcgatacattatttttcatttgagataaatttgtagtaatcatctgtttctttactcctggggaatccatactttgtaactatgactctcttttctgttggctacagcataatatgggatggcttttgccggaattttactctggcatttgatgatattgactccatgaagcagatcgttgtcgtgagaaagctccagtggcgtttgtggctgaagtgtcagtgtaggcaattccggattatccgcatcctcaaagcagtaaataacggggcctgatgccagcgcaacttgtccacgtaagtctttgactgcttcgttcgcagtgatcaggcgaggttgcatcggtaattcaagttcgatgtgatcgccttttttccattcccggctgatttccgcatatccatcgacaattctcaggagaatatccttttggttgactttcaatttaacgggggctttcaggttcgactggtaaagcccatatgggttttctgtaccttgtgcccatccgggaatacgcacttttatagaaaaggtactggctttatcgggattgacttgaatggaaacggcaccgtgccacggataagaggttaactgtttcaggcggacactgttatttttatcgatcggtatgcgtacttcacttcctatgaataagttgacatagatattatctccctgatatgcatagatgtaactgggcatggcggacatgattttcagaaacatcggtgggcaacaggggcatacatgccattcccatctgtcaggtttgtcggtattcaggggattctgataagtgtatttatcaccagacaaagaaacgcctgtcagtacattgttatagagtactctttccacttcgtccatgtagcgggcattacaggtcaattgattcatgcgttgactaaagaaacctgctcctacggctgcacaggtttccaaataggcgtcggtaggcaggaagtagtccggaccgaacttttcatcttcgtggatggcaccgactccgcctgtgatgaacatccgtttgcctgccatgttttcccaaagacgtttagccgtttcaatgtattgaggagattggttttcaagtgcggctgcggctaaaccggttgccatcaaggtagctcgtacagcatgtccttcgattgttttttgttcaagtaccgggatggaatcttgtgaatattccccccaacagggacgggaatggggaccgaattccgtttggtgatagcaagcgtctttaatccatttttcagattttcgatatccccatgttccccatagcggataaccgcagtgatgtcctctgttctcaatccagaaagtggccaggtcgtagtaatctgactcacggacaggtatggagagtttatctttcaattccggttcatttttatacaaccagtagagggtcattacggcttcttcgggaccggaatgcgcaggaacgacatttttacgtggttccggccccatataatctgccatatagttggcaaatcgggttgctatttcaagtaagcgtgtttttccggttgcctgataatagtgtactccggcttcgatcagcattccggcgttatatacatcgtgttgtccgcgcaggagccccccattatctccccatctatggtcattttccatgagttgggtgtgggtgttgatatagccggtaggttctgtttgctgagcggcataaatacggtcgatatatccgtcgattcgtttttccatttctttattgggatgtccggcaaggaagtctgcaatgccccggatactttcgtaaacgagtccgtcataccattctggaccatcgtgttgtttgatatctctctgtccttcggcaacacggtcgaaattccggaaggcatttcgtgtatcgtcccatccggggaaaggagtacactttccttcgaatttgtctaatacatcattagctgttacttttctccaggtttcaagtttcggactccagaaagcatcttctatccggacctggtctaactccggtaggtggagtatttgccgggtgtcagttgcaggagactggcaccccatctgcatcagtactgtgagtaccgctgcaacggataaatgtgttgtggttttcattgtacattgattttatagatgcatatatgtttataagtatcgccggggtgaaggtttgttgacgggaaggcaggttgattcggactgtccggatagtgttgcgtttcgagtgccaaagaagcccggtagttgtatcttttaccatgctttccggtcattgtggcgtcgaaaaagttaccaccgtaaaattgtagtccgggttcagtagtccatacctcaagaaagcgtcctgaggttggttcataaacggttgctgccagttcgggcttatcggaggtcttgcggttcagtacccaattatgatcgtagccatggccgaaacttaattgctcaaataagtcgttgacacgttttccaatggctgtgggatggcgaaaatccattggagttcctcctacttcctgaagaataccggtagggattagggtatgatcgacaggagtaaacttatctgcattgatcatgagtatgtgatcgttgatatctttgttgcctgctccgtatagattgaaaaaggagtggtgggtgaggttgataaccgtttctttgtctgtgcgagcttggtgagtgatgataaattcgttcttatccgtcagttggtaactcatggatacttgtaaatttcccgggtatccctcttctccgtctttagacagataggtaagttgtaaagtttgactatccggctgttcaacatcccatactaccatgtcgaatcctttgaatccaccatgaagactgttgggaatatcattgattggcagttggtaggcttttccgttcagagtgaattttcctttcctgattcggttaccatatcgtccgatagtggctcccagaaacctttcacctttgtagtggaggtatttgtccacatggtcgtgtccgaggacaatatcctcaaaatgaccatttttatccggggtccagaactcaacgactcgtcctccgaaattggtaatggcaatctcgattccgtttttgtttctcagaaagtagagatcggtttgtttcccgtcgattacttgctgaaagtcggctcttttcaattgtgaatgttgagcttgtactgtgtttgtgtgtatcatggcagtgagtattaataaaatgatgagtttagttttcatacgattcatgtttttagtttattattcgcaaatggttaattggtcagttctttttgtatttgttccagggatttgttctttgtttccggaagtctgagggcaaagaaaaagcttaagaacatcataatggcaaagaaactgaaaatgaaagtacctcctgtacggatgaagacaggaaacatccaagaaagcagggcggaccatacccagtgtgtcatgctacccagcacttgccccttagaccggacactattggggaaaacttcagagattaaaacccaaataaccgcacccagtgaaatagcaaagaatgcgataaatcccatcagacaggcaagcatataataacctgagaaagtatcctgacagaatcctttagctactaatgccaaagaaatagccataccgatagaaccgatgtagagtagcttttttcgtcctacctgatctatcagaatcattccgatcatggtaaatgtgaggtttgtcagcccgattactatagattgcatcatggcagagtcagtaaatacacctgacatctcaaaaattctgggagcgtagtaaaggatagcgttgattccagataactggttaaaggtagcaataaggaaagcatagaggattggtttacggtatttgcgttggaagagcttttcgccacagtttcctgtcgctaccagagattctctgatttcatgtacttcttgttcaatatccgcattactgacttcttttatgatgcgacgggcttcggtttccttgttttgctttaccagccaacgagggctctccggtacggtgtatagtaggagtgcaaacacaatggcgggaatggcttcgactcccaacatccattgccagtcgtgtgcaatgccatgtatccaatagttggagaagtaggcaagtacaatacccaagacaatattgaactggaagaatgcgacaaaacgtccacgccagcgtgaaggagatatttcggcaatgtacatgggaccgactacggatgaggctcctacggccagtccaccggcaaagcggaaaaataaaaaggaataccagtcgatgatggcagcactgcccacggcagaaacaaaatagaggaaagcaattatttttagtgctttcaggcgtccgtatttctctacgggtttactacagatgaaagctccgatgatagtaccgattaaagcgatggcaatggtaaaaccatggctgaaatcggataggccatatactgtttggatggatttttcggctccggatattactgcggtatcgaatccaaaaagtaatcctcccagggatgccacgaaggcaatgtaaaacatgaaattctttactgtatttttcataatgcagatgttttatagaccgaattcgatccggttaataacatgattctggtaacattcgtctaactctacaaagtatccgctccatccccatacccggacaatcaggttcttgtgttgttcggggtgtttacgggcatgtagcagtttctcccggctgactgtatttaactgtagctggtgaccaccaaggacaacataggttttcacaagcatacccaatttttcaatggtttcgtcgttgctgaatacagactggtcgaattccagggtgagggggccgccattgacaacacgatccaggtgctgcttggtaaatgatttaataacagatatcggtcctttttgcttgagaaacaggctgggggaataatttgccgggatcatttcaccatcgttacgtccatcgggagtagcacgcaattgattggaatgaaaaatgtagtacatggctgttccggtacctgcccgataaactcctccgcgttcatttcgtttatcggctaacgactgatcgaaagagtcgagtagagctccggctatcaggtcggcataatcattatcctgtcccattttgggagcttcttctcttagctttttctgtaactcttcatagccttggaagttgtttcttatagcagtaagcagagtggtataatctatgttctgttcttcaaaatagtattttttcagagcagcaagggcgtcggtggcagttgcaatgccggtcccgtgaatgccatagttattatagtaagatccttctgaaatatctttggctctttcaatggtgccatccataagcaaagacatcataggagaagggataatgtagagattccggtgtttttcgcagattgtatcgacttctttttgtatttcctgttcaaccagtgtataaaaagatggataatccgggcaagtgttgagcttttcaatgcatcggtctacacatcctattaaagaaacagcgtctatattgggaatatccatggctttaccggggatgatgaactcccagcaggcagccacgacatagttgtatgcgtcctctttcgaatatcctttgcggataagtcccggaatgatgacgtcgtcattgctgtattgtggaaagcccagccctatttttgtcaggcgggaacctaaagtgaatatctcgttgggagtaccttggtctacacgaatattgattttgggatcaatcagcttcaattcgtaacttgcttgcaaacacatgcgtgacaggtcgttgaacaagtattcaccgtttgcgttgcgtcctcccaatactaagctctgaccgttgtcgccttgctgcatacccggatacaggtcactgtctttgttgcataccaggaaaaattcttcaagtaagtcaaatgcttcctctttggtaagtgttccattttccaagtctttttgatagaaaggatacatatattggtcgaaacgaccgagtgtgttgtgatagttacctgcttcccaaatggagaaatggagaatcctcaaaagttgtagggcctgtctgaagttttgggctccttctgttttgacggtgtgcaaagtatatgctgtttctgtctcgttaatgaataatgcatattgctcgtatttctcaattaaattttgtatggatatgatgctttgatatattgcttgcaggaatgttttttctctttcatttaatgagggtgtttcctgacgtttccgaatctcttgtttccgtgcttccaacccatgtcggattgtgtaagcataattaggagagatgttacataccgtacctttttcatggatataatgtttgcttttgatttcattccattcttccggggtatagggatccggtatttgggtgagggtgcgggtaaaaacgattctttcacccggaagtataaccggagtttcggcatccattgaggcagcaaagcaagctgtggcgcgttctacaggagataaaccttgtagagcataggacgtactcaatttatcaagtcctacgctctgtagtgttcttctttgtgagtggtgttgtttatctaaaatatacgtttttagatagttaattctttcgttcatacaattagatttttgatattattttcttcgaatacattatagatttgtggtgtttttccggtatcgaacggagggtgatacttttctccgatcattgcgtatttggcacctgctgtccggtgatatctgagggtctcgacgcgtatcaggttttgggcatttttgattctttcgaaaatggctgtcatattttcccgggtatcgttgacacctggaatcagtggtatccgaaggatgaaatcctgccctgaatcgcaaagtacggtaaggttttttagtatgatcgtattatctacacctgtatattttcgatgcatctccggatctgtgtgtttgatgtcgaacaggatcagatttgccaaggaaataactttgctgaaagtatgagtgtttgcatatccgcttgtttcgatagcagtatgtatatccggaagttgttcgagcaattcggtgatgaaatccggttgaaacaaaggctctcctcctgttagtgttattcctccccggttaagcctatagatatcccggttcttttcaattatggcaatcagttcttctacagttatctgatatccacaaatgcttttgactcctttcttaatcatgtattgtggttgtggtgagatgccctcggggttatggcaccatgcacagtgtaaaggacatccttttaagaatatcgttgttcggattcccggtccgtcgtggatggcaaactcctctatgctgaatattgttcctgttttcattgtgtttggattaacaatggcaaatatatacataatattttgaacaggtgcgaactggtatgtatgttgttgagcatgtattcgtgttaaaatacagaatattaatagctcttattattcatatgggtaatgtttatgggagtagaggctattatccggcatttacaaaaaacgaatgtatccgaccacttttagaatgtatttttccgaatgggtgatgaaccggtctgtttactgacctttgccgttcttgaattcattgggtgtcactccacagaaacgcttaaatgttttgctgaagtagctgggattattgaatccaagctgccatgagatttcggcgatagtcagattggtttttataatctttactttggcaacatcgatcttgattttatttataaattcggtggcactcagatttaacagtttcttcagcttattgtatagttgggttcggctgatgttcatgtgtgcagtcaattgatcgacactcaattccggttcttcgatatgttcgatgacgaattgggtcaacgatttgataaactcttcgtctttgttgttaagttcttcgttgagttcgaatattttcatatcgtgataatgttcgcggatattacttttagctttgagtaaattggtgattctgaggttcagttcatcaaaagtgaaaggcttttcaatataggcatctgctcctgccgataatccctgcagctcgttctctttcgaaggttgagaagtgataagaatgaccggaatgtgagaatactcccgagaggttttaatatacctgctcaattcatatccgtccatataaggcatcatgatgtcactgataatgatgtcgataatgtgtgttttcagcaattcgactgcttcctgcccgttataagctgttttcactttatataaacgcagtaatttactttttaatatgttgttgatatccggattatcttctaccagaagtacagtcattttcttttctgtatttgcggcattcatatcttcttttaacccggagttattgagtaggtatacagtgtctgctactacgtcgggggaattgacgatatccagcgtttcatcgggaacgatcatatctttggagtcttctaccagaggcaatcttactttgaaggtcgtgccactattttgatggctttctatctcaaccgtgcctgaaagtagttgaactaatccattcaccaaagccagaccgatacctgtattagaatatttctgatcagacgaatcggttttgtggaaaggttgcatgacagcctcccgttgttccggatgaatataagagctgctgttgtggcaagaaagaatcagttgtccggcattcttatccacatcaatcctaaagtttatttcactctgaggatcagaatgtttgaaggcattgctgagcagattgctgatgattttttcaatcttgtctctgtcgaagaccgtatagtaggaatctgttgaggttgtatattgaaagacaacctgtttttgtctgaagacagggatgaacaattcgaagatactacgtccgtatgtcatgatgtctcctttcacatattctatacgggcgtgatcggtttctacggaacgaaactccagaagctgattgataagaaactgaaggcgttggatgttccgattgattattttcatttcttctccggtgattgtgttgttccggctgattgatatatcttcgaatacggccatcagtatagacaaaggagtcttaaattcgtgggtgatataagtgaagaaatttagcttatgcttgtttagttcgcgcaggttgttcttttccatgcgttcgatgcgtatatccattttatcacgcatgcgaatgcggtagaaacggacaattataaagccgatcaggagcccgattaaagagtaaatggtgatcatgaagccactcaatagaaagtgaggaaggatgtttacagtgatttcacggcggtcgaatacaactccgtttttcccgataacccgtacatggaatttataagttccgggatcgaggttggtataagtgactgattgtgggatttgttgtgttgtgttccactcggtctccataccctccagataatattcacaagaaagttgtgactgacagttttcattgtagttgattaccaggaagtcaaaagtcagggtattcataccgtgaggtaagcggataagggacgtactgtcgatattgctttgcaggataccatccggtgacggctgcacatgcttattgaaaaccttgaagtctgagaaagtcaggtggatatcgtttgtagggttgttatggttcagtccttccggtcggaaaaagcatacaccattgatacttccgaagtagagagtaccgtttggatctttataacccggacaggtattaaactgattcgaaatcagattgtcggataccttgtagtgggcaaaactctgactttccggattaaatgagaaaataccgttgtccgtactcatccatagatagccgaaactgtcttcctgtatggaatagatgtctctctgccggagttcgttctttttcccgaaaacctgtatactgtctgcatttgcatcatatttcatcagtcctccattactggtgccaaaccagacatctcctttcgaatcgataaagctgcaatagatgttatcgctggtcatagttttacaacctgtcgctcctttctggtatcggtggatgctatgggtaggaatatgataccggaagattccgttgaagtgtgcagaaaaccagatattatcctttttatcacgtatgatgtcgtcaatgcgtataagtcggaatacatccggaagaaagggggtgaatgaatctgtctgaaaatgatagatattgactccctggcttgtgcctatgaacatagtatcggggttgtgaacatagagcttatagattgaattattggataaccccgtatctcttcctgccaaatttttatatgagcggatatatcccctttccaaatccaccttttgtaggccgtcgacaaaattgccaatccatatattgccggagtaatcttcggctaatgcgtgtacgttgtctccgtttagcgatggatgggtcgatttgtttaggtacctgatgtgaccgtccggataaagaatggagattccgtgatcttcggaagcaaaccacaacgctccctttttatctttgatgatgttactgatcgcttttccttttaggtattgtttcccattatctgctatcaggtagtggaagttgttttcagtcaggctggtatagttgatacctccaaagaatgtaccgatccacataatatctccacgacttttataaatggtgtagattgcattatcggtcagtccggactggacatctttcgcatgctggcggtattgtacgtaactgttgtccgtgtagtcgtagatgaaaagtccgttttcggttccgatccatagatttccccgcatatcttcctgaatgcagcggatatagcgcatgtcttttctgtcttgtgaagagaactccactgaaacgaactggttataattcttattatatcggtacaacccgttttcggtagttcctagccatagagtgccctgagaatctttgtagatggaagtgaattcgacaggatagtcggaagagacttctgccgctgtgattttccgggtcatttgtccgttggggcggaaacaataaatcgtattcggaccgacagcccatacatttccgttaatatccagtgttacttttataatcaatcctttgtagagcagtgccatgctttgctctactttattatacgtatagagtccggaatctgatgcgatgaagactgaacgtccgtcgtagaccatgtccagcacatatagtggagtcttggtttgcggaacaatagtggtgaacttctctttcatcatatcgtataagcacaacccttcattagttcccatcaatagggtatctttcccaagcagaagcagtttctcgatgcagtttgaagaaagtccgtcatccgacttgtagtattgtttaatgttgtatccgtcatacctgttcagtcctttgagggttgcaatccaaatatatcctttcgaatcctgcacaatatcgcgtacggcactatatgtaagtccgtgttgactgcccagagagtggaacataagttcattctgttgtgcatttagtataacagaagaaataaataaaatcagggtaaaaaagctcttcttcattcgtctcttaattacgtacaacacaaaagtctgaaataaaaacgaatcagaaaggcacttatggtcacaaactgatatttatattcactatggtaatgtttggtgtaaatatgaatatgagtatcagtgaataatttattgttctatggttcgggtctcttttcgcctacttttgctgaaacaacaaaacagtaaaatacgaatgcaaaaacaactgagtatggaaccacacaaaatggactcgtcctgatccggcttcgggacttgacaaagaaactaaaaatgtatgaatcctttttaatgactaaattactaatattatgaatctaaaagatctgaacaaccttagagcagataccgaaggcaggataaaagccgtcttcttaatatgcatgtttgtgctggtgtctgcaggtggatttgctcaaaacacaaagagcatttcgggtacagtgagagagaaaggcagtaatgaaactgttattggagccactgtacaagtgaaagggacacacaacggggtgattactaatgaaaacggagagtatacgattaaaaacgtatctccgggacaagtacttgttttttcgatgatcggcatgaatacggttgagaaaaccgtaggcagtcagaatcggatagatgtactgatggattcgggagtgctgattgatgaagtggtggtgactggttatcagactcagcgtaaagtagacttaaccggatctgtatccagtttgagctccgaccagtttatgcaaaccaatccgttaagcctggaacaagccttgaaaggcaaaatatccggtgtacaggtaatgaacaatgatggtgcgccgggtggcggaatcacgattaagattcgtggagccagttctattacggcaggcagctcgcctttgtatgtcatcgacggtttcccgcttcctatctcggacgatccgctggaaagtcctttagcaactatctctcccgatgccatcgagagtatctctatcttgaaagacgtatcgtctactgccatttatggggcgcagggtgccaatggtgttgtgctgattactaccaagaaaggtgcggccggtatgagtgagatttccgtaaaagctacttatggtatcagtaaactggcaaattcaatcccgatgctgggtgccgaagattacatgcgtgcatatatgcgtgatatgattatgagcggacgctggcagaatgccgatttctaccaggagtataaagatcaggtatggaataccaatccttcccgtttccagttctatccggatctctgtttgcagaatggtaccaagcagaattatgaagtgtcttacagaggcggaaccgaacggatacagaactctaccattttctcgttgatgaacgaagacggtatcgcaatcaataccgggtttaagcgattctatttccagacgaataacagcataaaactgcttccgcaactgactttgaacacgaatatctcgtatgagcacaatattcgtagtggtgctttctggacagaaggaaacattttcaatgaaatacagactttctctccgcttgttcccaaagagtggactttccaggagatagatgacaacctgtactatacaggtaaaatggataatccttatcggaagctgaaagacattgattacaataataaaaataatactttcttcggtcaggcggaattggtatacaacattaatgataactggtttgtaaaaggcggtattggcgttcgtatccctaaaggggaagtcaaggaatttgttccgaagaccatccagcgcggttatgataataatggcttggctacgtatgctacacaaagcggattaaatatgcgtggagtgatacaggccggattcaataaagtattcaacaaggtacacagtctttcggtgaatgccgtgtatgaggccaataccaataagtatgaaacctttaatcaggaatattcccagttcaataccgatttggggtgggaaggtatttatgatgcaaaaagtggtaaccatgtgaagtctcccggtgtatcttacgaaaagatagccatgctctcgggagtgtttatggccaactattcttataaaggccgttacttgctgaaagcttccatgcgtgctgacggttcttctaaattcagtcccgataaccgttggggattctttccatccggtgcgctgggttggagagtttcagaagaagaattctttaagaatgtgccttggctggagaagaacgtaagcaacctgaagctacgtttcagctatggccaggtgggtaacgaccagattgctccttatgcttatgcacagacattgtcttccagccagcgtcaggccatctttggcgatggagccatcccggctttgtataccagccgtatggcgaacccggagatcagttgggaggtgacggaagagtttaacggtggtctcgacctggatatgttcaataaccgcctgaatgtgtcattggacctctatacaaagactacccgtgatatgctgctcgaacagaatctgccacgtacttctggtttcgggaaggtgacccgtaacattggttcggtgcgtaaccgcggatttgagatcagtgtaggcggtgtgcttattgataaaaaggactttacctggaatgctacggtgaactttagctccaatcagtctaaggtgcttagcttaggtactgaaacacagatgctcgaaggacgccccgtaggttcagcttccggttcggagaatgttctgattaaaaaaggatatcctctcggactcttctatggtttgcagatggaaggcatccgcagcaactggcattcggattataacggtataggcagtgccgattctccttggtggtatgctaccgagagagagatgccttacggtttcccatcctttgccgataccaatggagacggaaaagtggatatgagtgaccgtgttgtgatcggagacgtgaatccggtgtttatcggtggtttgaacactcgtctgcgctggaagttcattgaactggctatggacttcagttggtcatacggaaatgatattatcaatggtaatgtgtacaacttgatgaacaacggggatatccgcaataaatcggctgtgtattataaagatgcctggtttgcgaacaatcctaccggtacttttacaggtcccggtgccattgactggtcaggatatatgtgggctgcttccaactcggagatggtggaagacggttcgttcctgaagatgaacaacctggctgttaccttccgtttaccgaagaacgtattgaaggcttggaagattaaagacctggctctgacgtatacgattaacaacgttttctgtcttacgaactattcgggatatgaccctgaggtacgtagcggtagctctgtgaacaaccgtattcttccgggagtcgacatttcggcctatccgtacgcccgctctcatatattctcacttaatttcaaatattaacaggtactgccatgaagaaaatattattagcccttttaacctcttgcgccttagtgtcgtgtgaggggtatttcgaccagttaccgaaaacagaacttccgtctgagactttctatacctcatatgacgctgctttgcgtaatgttgctatactctatgccaatgccgggcatgtgaacgatggaattatgaccagtgaccggtttatgatgccttcgctgatgaatgaaggtccgttcgacctgacatctacctcgggtagtgtgctgaacttatggtcaaagcattattcatatatcgcgcaggcgaacctgatacttgaaagactggaagctaacaaaggagtgattgacgagaacgccggacattctgcattggacaaggccaccatcaccggatcggctaccgagatgttgatgggcgaggtgcgtttcctccgggcttatgcttactttactttgtaccgctattacggtggtgtgcccctggtcacagagcctaccggaccgaaaccggcttatgtgccacgggcaacccggcaggagatgttcaagtttctttatgacgagatggcttatgcactggataagtgtctggataaccgttcgggcattgcttacggccgtgtgacgaagggagccgtggcaggtatgctggcaaagatgaagatattccatgcttcttatatccgccgtgcggaaatgtatggggataagatcaatgaaacgacggttggcgatgtggataaaacgacgttatatgccgatgccgtgaagttgtgtgacgatattattgccggtatatacggaacttatgagctggaagagtacttccccgctgtatttaccaaacgcaacaacgagattatgttcagcgtgctggcagaagaaggggtaggcaccggaaacaagataccgatgggctttgccggtgaaggcaagtacggtgctaccggcggaagaaacctgacctcgtggctgacgctgttatatgacataccgatgtgggaacataactacagtttcaaggacgtgtgtatggattacggacaggtggaccgcttcaatgccgagagtccgaaaccgggaacaactccttatgatttgcagaacctttatgaccgtaccgggaaatactccataacgggagatgttacccgtcgcatgtggagttcggtgaaaggctgggtgaccggtcctaacagtggtggtgctccggtcggcttgtgggtattcgaacctgccggacgcgaactgggtcctgagttctacatcgaaccgggtaaagtaaacgattataccgaagagcagcttaaagtcatggatgtggctctcgagagtcacgaacgggcttggtggaagaacgagacgaacgggcagaacaagcccaacctctggaattgtaactggtggcagttgggtaagttccgtaacctgaatccgagtgagctgagctctacttttgatatcaattacggtggtgtggactatcctgttttacgtctggctgaggtttacttactgaaagcagaagcccagattatgcagggtcatgcttcggaaggagtgaaaacgatgaacatcatccgtgaccgtgcttgccatcagggttccatcaaagatatgtttgtctctcagggagatgctccttatacttaccaatcgggttcggttatgatgattcctacgaatatcagtccggccaatgcattgaaggagctgatgtatgaacgtctgcgcgaactggcagccgaggatgattgcgggtggctcgatgtagcccgtttcccggatgtgtcgatggtcgacttggcagatatctgccgttatcgtgatcctctgcagttctttgatccgtttggtgatccggcgcgtggagagtacctctggcatcttttcaacgaagagaaggtataccgggtgctgatgccgataccgtttaccgagttatcgttcttcccagagatgaaacagaatccgggatatttctaatactaaatacgaatggatatgaaaacaaataaactgattatagggctgcttgctgtggcagccacttcgctggtttcctgcgagaaatttggtgcagacgtagagacaccgtctgtcagcatctccgtatcaccccagaatccgaaagtaggcgaagaggtgacggtgaccatcaataccgatgcccagtacctgacgctttttacaggtgatgaaggcaagaagttcgaacgttcgcgcgttaaagccattatggagcacgattgggacagcttctatgaagagtgttaccgggttccttatgccaaaaatggggaaaagaccctgttttataaatactttaaagactatcagtccatcgaagaggtgaagaaggattttgagttcttcggtgccattgacaatatccagttggtcccctacaagaaaggggactttccggaggctttgatggagatgagctacatagggaccaatcagctgaagtttacggtgaccgaccggcgtatcccttcgggcatacggatgaaaccggatatccacatctttggcggactggccaaccagccgggtaatacgattatcgaaagccgctttgtggcgtgtgatgccgaccgtgcgattcgtaagtattctaatgatgcgtgggtggctgcttacttcggcctgcacaccgagcagttggaggactttggcggatatagtgccggatacaagtactatacgatgcaggatgagcgttcgtacggcgcattccagaccaacgatccgctttcacgtcgtcctaccgaaggattttataaactgggcgatatgtacaatcgggatacgtacctgcaacccttcctggatcatggtgaaaagatcattctccgccaggtggacatgtacgtcaacggccgttccacctttgcggcagcggacgattcgccttataagtacgatctggatggggatggagtattggaatcgtatgaatgtgaactcgatcctgctaccggacttccggttcatgaagccgactatacgaagtataagggtttccagggcgatgtctatctctctttcatagagatggggaccgacgagtacgaaccttggaacacgggcgtttcgctgggttctgtatacactaccggaggaattcagaaaacttataagtacatttacaccggagccggcgattttaccattacggccgttgccaccaatgtgggtgacaaagactataaggggatcgattatagtgaagagcggagtaactcgctggatgactacagtcataagagagcacttagcagtgtgaaaatttcagtgcagccgtgatgcttctctgccgaatgtaaaacagtggttgagtatctgcatggcagcgtttatccaccagggccccggacgaagtaccgccgtatacccggacgaagtaccaccgtatactcggacgaagtactgccgtatacccggacgaagtactgccgtatactcggacgaagtacctgcgggtaaaaagtgccacacagccctcctgtgacggatgaggcacagcaatgctcaactactgtagattactttattaattaaagaatggtgcctatgaaacttaagtattatatttcatccttactctttctctgtctgaatatttcttctctccggggtataactccccaaatgaaagtcagtccggacgaaaggggagtaagctcgctcgtctttcagggggcggacaatgtccgcaactatatagaccacgggaagtatctgggcgatttgaatctggcttacgaagtcagggggaaaagctatgcagtctctctggccgatatttccccacagattctatccgccacctccgataagatacagatattctggcagcttccttcggatgtacgcctctatcagactttcaccatcaagggtgaagaggtggactgggagattgagtttttcaaccgcagccaccatccggcgacggtgacggacctgtggttctctttgcctgtcggtgctttggacgaatcgatccaggcacatcagaatctgaaccggcacttctctctgaacgggaatgcttcttttttctactggactccgctgactgggcagggtgacatcctgctgatgaccatgcggaagggaacttcgattgaatatgccacagcggacggcaaatattatctgcattccacccatgctgtggaccgtaccgatgatacctggagattgccgtctacctcaaagactgtacagccttacggacactacgttaccggtttcaacttcacgcttgccgcaaatcacgaggagatacagacgaaaatttatgataagcaaggggtggttgtaaaggttgcccccggcatggtcgttactccggagatggaggtctgttgcgctttgcggtccaagctgcccgttaccggattgacggcggaatatcccgcggagatgcagatcaccagccttggacagaaggcaggagatacatatctgtataagtttcgtttctcccgtttgggagagaacctgataacggtacgttacggagaagatcaggtctgtttcctcgacttctttgtgacggaacccctggagaccctgattaaaaagcgggcacgtttcattgtcggacggcagcagcatcgcgacccttccaagtggtacaatgggctttatagcctttgggatatggagaaagccgagttgctttcgcccgaccacctgggagacttgcgggaagagttcatggtgggtggttcggacgacccgtccaacagcaagccggtctatgtgagtgaaaagaatgtcatctatcccgaccgggaagaaatcgcctctctggaatactacgaagaaaacttcgtatggggcaagctgcaacgcacagaccgggaatatccttatccgtacggcatttacggcagcgaaaactggtatcagaaccgtagcgggaaatatggtggatacgaagatggcggttcgggcaagggacgcatgtggcggaccttcgactataccactcactttgccatttattataacctttaccggatagcggaggataatcccgagatggtttcctatcttgatgccgatggttatctggaacgcgcctaccggacggcaatggcctattttgaagtgccctataacattttgatgggcaagcaatggacatttcatggctggacggactgggcttataaacaaggcaactttcacgagcgctatctgctcgatatcatccgtgcccttgagcagaaagggagagagaaggatgcggccaagctgcgtcgtgagtgggaaaaaaaagtgacttatatggtttacgaagatccctggccctttggctctgagatgtttgtcgaccgtacagcctttgagtcttcctattacgtggcagagtatgcgaagttgaatcctatcgagccggaagagcagttctggtacgacaagaacctcaagaagtggtattcgtatacttcgttcgatactgcgatgatcgaccgtttcatgcagaaccagctggatgggaaccttgcgctgcgcggattgtttgagccgggatatgccaatctgggcacagcgtggagcggacaatacgtaaacctcgactatatgacccaaatgggaggtgtggcattgctcgattatgcctatcggttctccgaccggccggacagatacatcaattacggatataactctttactggcttcatgggcactgatgaacaccggtacgaaggagaccggctttggctattggtataagggagagcggaacgatggtgctgtcggctgggccttctcaccctaccagaactcacgcacttacatgaactatatcaaagtggggcgttctccctggcggtttgatggtgaaatagaccacgggcttaccggaggcatccacggttcgggagtctatctggtggatgatcccgacttcgggctgatcggctacggagcgaatgtccggacggataagaacggaaccgtgagtatcactccccttgacggagtacgccggcagatacgtatcatgactcctgtccgtttctccatcgaattgatgcaggacggattccggaaagatcatcccgtcaccctcaaaggggcagccgaagaactgagcttcttcatcgaaaaccgttccggcaaacgtcacaacaccaccatccggaccgaaggaatgccggaaggtaaatatactgtcatgactgatcacaaaatgataacgacattccacattgaggcgggtaatacacatcatccttattatatagaggtgcccgttacggacaaacatacccaagtgaaacttttaaaaacaaattagaatgaaacatgtactaacagggctatttctgcttctccttacgacagcctgttcggaagagggacagcagacaataacacccgttccctttaatcaggtgactttgaccgatgggttctggaaagaaaggatgcagacggaaatcaacgtaacggtacctttctccgttgagcagagcgcaccggcggtagagcgtttccggcgttgcgccgcctttctggcaggagactccacagcccttcccgagactcaccgctttataagctccgatctttataaagtgatggaaggagtggcttattcattgatgattcgcccggacaaggagctggaagagtttatggatgaagtgaccgacctgattgctgcttcacagaaagaggacggatatttatatatttcgcatatttgtggtaatcccgatccccgagagatgggagagaagccctattcgtgggtcgttcatagccatgagctttataatgtggggcatctgtacgaagcagcggtagcctattatcaggctacaggtaaggataaactgctgaatgtcgccataaagagtgccaagcatgtgaataaggtgttctttgaaggaggtgaccccaattataatggcggcaaaccggtcaatcaggctccggggcacgaagagatcgagctggcactctgcaagctataccgggtgacaaatgatacactgtacctcaacatggcaaagaagttccttgagatcagaggagtcacttaccgtccggaaggtgagggagtaatggcgccgacttacgcacagcagcatgcgccggtgaaagagcagaccgaagctgttgggcatgccgttcgtgcggcatatctatacacagccatggcacaagtcgatgccctgaccggactgaatgactatacccgtgcgctcaattctatttggacgaatctggtcactacccgtatgcatatcaccggcggccttggagccatagaggggatggaaggcttcggggctccttatgaactccccaatctgacagcctataatgaaacctgcgcggcggtagccaacgtgttcttcaattatggtatgtacctggacagcggagacgctaaattcctcgatatagccgagctttcactctttaacaactcgttggcgggcatcaacctgcatggcgaccgttttttctatgtcaatcctcttgaggcagacggagtgagacgctttaatcatgggaatggcggacgtgccaagtggttcgggtgtgcctgctgtcctcccaatatttcacgtctgatcctgcaagtgccgggctatatgtatgcctatagcaaagacagggtttacctgaccttgtatggcggcagccaaacggaaattcccctggaagaaacccgtgtgaaactggagcagtcctctgcctatccgttcgatggaaaagtgcgcgtgacggtgcagcccgaaaaggcaagtaaattctcggtttgcatgcgtatccctacgtgggcacgctccggagaatttgttccggggggactttacccctataaacaaccggggcacacggaaattgaactgagcgttaatggacagaaaaccgatttcaggatggagaaaggatttgccgttgtcaagcgtaactgggagccgggtgacgtggtcgaactcaacatccccatgccggtgcgttttgtagattgcatccccgaagtcagtgagaatataggtaagaccgccgtaacccgcggcccattagtctactgtgccgaagaagtggataatgccggccccgtccaacgcctctatctgggcgatgttaacgaatcacaggcaaaggtggccaatatatcctccggtgtgctgcaaggattggaaagtatcaccctgccgggtatggagaaaaaagtggaaggcatcaccacccgtgagatcacgatggttccttactacgcctggtgcaaccggggagacaaccgtacgatgctggtttggttgaacgatgaggcctccaccgccagcatcggccagcaagccatggcttatctccgtaatatcaaagcggtgaacgtatcctccctggctgccggaaagaatatttccacacgtgcgctttgcgacggaaaagtatctgattcttccgcagacaagctgactgaaaggtggatgtccgacggctcgggcagacaatgggtgcaggtagacttcaaagaaccctttctgctgaattccctttccatgtattggctggacgatcaggaaaaaatagccgttccgtccggttggtcggtagagtataagtcggatgccggatggaatccccttgaactttatgtgacggactcatatcaggtgggtaccgatcggttcaacgtagtacatccttcaggcagtgttgaagtggagtccgttcgtattcttatagaacctcagaaaggaaaatcaataggtgtttcagagataaggtttgagtaggttcttttttttcagcaggaaagagggtgttgtacagcagaggcaacatcctctttctctatcagtacatgccgtattctcacaatgtaaaaacaaaaaaggtccgccgtaatgacgaacctttgtttgctcttcctcttggacttgaaccaaggaccctctgattaacagtcagatgctctaaccgactgagctaaggaagaatgatttgtttttctcaattgcgatgcaaaagtaataggatattttgaaatatgcaatatctttgcaaaaaaaaatagtgaaatggataaaataattggattgggcaacgccctggtagacgtacttgcaaccctgaaagatgatacactccttgatgaaatgggattacccaagggaagcatgcaacttattgatgatgctaagttacagcagattaacgaacaattcagtcagatgaaaacccacttggcgactggtggagcagcggcaaattccatacttggactcgcctgtctgggtgccggaaccggtttcatcggaaaagtcggaaatgacgcttacggaaacttttttcgggagaatctgcaaaaaaatggcatcgaagataaattattaacgtctgatctgccgtcgggagtcgcttctacttttatttctccggacggagaacgtacttttggtacttatctcggtgctgcttctacgctgagagccgaagatctgacactggatatgttcaaaggttatgcttatctgcttatagagggatatctggtgcaggatcacgatatgattcttcatgccattgagttggcaaaggaagccggtttgcaggtttgcctcgatatggcaagttataatatcgtggcaggcgatcttgagttcttctctttattaataaataagtatgtagatattgttttcgccaatgaagaagaggcaaaggcgtttacgggtaaagaagatccgaaggaagcccttgaactgatcagcaagaaatgcagtatcgccattgtaaaggtaggtggaaatggttcttacatccgtaagggtacggaggagatcaaagtagaggccattcctgtagagagagtgatcgatacgacgggagcaggtgattatttcgctgccggatttttgtacgggctgacttgcggctattctttagagaaatgtgcaaagattggttcaattctctccggaaatgttatacagatcgttggaaccacgattccttgcgagcgttgggatgaaataaagttaaatattaacgaagttctgtcagagtaagcaggcaatgagttacttttacgtctcattttaacgaaaagtgtatgaaaaagtttctgaatagacgaaatggtgtcctgttggcagccgcattggttgtcgtagcattctttagtttcaagagcggtgacgaccgcaatttccagattgctaagaatctggatacctttaattctatcgtcaaagaactcgatatgttttacgtagatacgctcgatccgaataagacggttcgtgaggggatcgactatatgctctcgtcactcgatccgtatacggaatattatccagaggacgaccaggctgaactgcaacagatgttgaacgcttcgttcggaggtatcggatctttgatcacgtacaaccagaaactgaaacgttcgatgatagccgagccttttgaaggaacccctgctgctaaaatcggactgaaggcaggcgatatcctgatggagatagacggaaaagatctggcgggaaaaaacaaccaagaggtgagccagatgcttcggggggcagtaggtacgagctttaagctgaaggtagagcgtccggacgaaaaggggggtacccggccgttggagtttaatattgtacgtcaaaccatccagactccgatgattccttacgatactatctttaataagaatgtaggttatatcaatctgagcaccttctccggtactccttccaaagattttaagaagacattcctgagactgaagaaagagggcatcacctcattggtgattgacctgcgcggaaacggtggcggacgtctggaagaagcggtagagattgccaatttctttttgccccgcggcaaagtgatcgtgactaccaagggaaagaccaaacaggccagcaatacgtataagacattgcgtgaaccgctggatctcgatattcctattaccgtattggtaaacggaggcactgcttccgcgtccgaaatcctttcaggagctttccaagatttcgaccgtgccgtgattgtgggaagccgtacgtttggaaagggattggtgcagaccacccgtccgttgccttacggaggtgtgatgaaactcacgacttctaagtattatatccccagcggacgttgcgtacaggccatcgactataaacaccgcaatgaggacggcagtgtaggtatcattcccgacagcctgactaccgtgttccatacggcagccggacgtgaagttcgcgatggtggaggtgtgatgccggatatcgaagtgaaacaggaaaagttgcctaatatcctcttctatctggtgcgtgataacctgatttttgattatgcgacgcagtactgcctgaagcatccgtccatcccttctccgcaggagttcaaggtgaccgatgccgactataacgacttcaaggcaatggtgaagaaagccgacttcaagtatgaccagcagagtgagaagatcatgaagacgctgaaagaagctgccaagttcgaagggtatctggatgaagcatcggaggagatcaaggcactggagaagaaactgactcataatctggaccgcgatctcgattacttctcaaaagacatcaagtcgatgattgccgatgagatcatcaagcgttactactatacacgtggagggatcatccagcaattgaaggatgacgatgggctgcaagccgctctcaagatattggccgatccggtcaaatacaaagaaactttgagtgctccggtaaagaaataataaatggggctgttatgtcacatgaagtgcaccccaaaagtcagacaaaaaacttttggggtgcacttcaacgacggcaccgagttgctcatgaaatctctgaccaccgaccaggattattatttcgccgtggaggcctttaatgaaaatggtgtatctttaccctccgaaccccaatatgtagaataatcccgaatagccatgaaacagtttgttcttttcttcctcagtatcttcctgctgaccgtgggtgcccgttcgcaagaggcgtatcagaaaaaagtattcatctcctcccggggagattcgctgaactaccgtttgcttcgtccggagtcggaaaagccggggcagcaatatcctttggtgctctttctgcacggtgccggcgagcgggggagcgacaacgagaaacaattgacacacggtggacagatgtttctcaaccccgtgaaccgtgagaagtatccggcatttgtcctcgtgcctcaatgtccggagaaggattactgggcatacgcctcccgcccttcttcgttcgttccttcggagatgccggtgggacaggagattactcccgtcttgcgtgcggtaaaagaattgctggacacttacctcgatttgccttcggtggatcgtgactgcgtttacgtagtgggtctttctatgggaggcatggcgacgtacgaccttgccatccgctttccggatacattcgccgccgccgtccccatttgcggcacggtgaatcccggacgcctggccgatgccgtgagtgtccgtttccgcattttccatggggatgccgataacgtagtgccggtagaaggctctcgcgaggcttataaagcgttgaagaaacttggagcagaggtggaatacgtcgagtttcccggttgcaatcacggcagctggaatccggctttcaactatcccggattcatggagtggctctttgccagccgaaagaagtaaggtgccaggagctcaccctttcttaatccgtggtgctttctttctgttgattacttattcgtcggcgggactaactgtcttctttgggagacgatcaggattaagccttctcttcgtagtcaccgtttgccttgatcagttcgatcagtttttccacggcttcttcttcgggaatattcttctcgatgcactccttccgtttgtaaaggcttaccttgccacggccggcacccacgtagccatagtcggcatccgccatctcaccgggtccgttgacgatacatcccatgatgcctattttcagtcccttcaggtgtgaggtggctgctttgacacgggcaatcgtactttgcaggttgaacagtgtccgtccgcatcccgggcaagagatatactccgtcttgctggtgcggatgcgtcccgcttgcaggatgccgaaggcggtagcgtcgatcaccgcatggctcagttccccttggttaaagagataaatgccgtcacacagaccgtcgaatatcagtgctcccatgtccgcaccggccttgatttgcagatcttcggctgcattttcggagtagtgctggaagaagatgaccgggttctgcaacccttccaccgtcagttgatgggccagcgcacgatgttcgcctacgcggttagggtggttgctttgcgagatcaccactacttcgggatgtcgtttcaggcaggccactacctcgtccgtaagtgccatataaggaatgaagaagaacttcagtccggcggcgcacgtttccatcagctccagttgggcataattgaaagcgggccacgtgtccggttcttctttccacacgtcggcgtcgaggatgtattgcatacctttttccggctgttcgggcagttcacgtccggcgtagatataatccggcgtgaattgcgggttggtctccgtccgtccgtccatgcggtcggcaagcactaccggcagatggtcgccgccaatgttccgcaccggttgcgttttgcgcctcgtcggagagaggtagtcgaagtccggtgcctccatgccggggatgtatgggtgatcctgtctcccgacaatgtagtcgaccagtttgcgtgccacgggaatttcggcttccggctcctcactcagtgagacgcggatggtgtcgcccattccgtcggacaataaagcaccgattcccaaggccgatttgatgcgtccgtcttctccgtcgccagcttccgtcacacccaggtgaagcgggaatgccatgccttcctgttccatcacggccaccagcaggcgtacggttttcaccattaccactgtgttggaggccttgatcgagattacggcatccgtgaacttctcgtccacgcagatgcgcaggaattccatgcacgactctaccataccttcgggcgtgtcgccatagcgggacatgatgcggtcggacagtgaaccgtggttcacgccgatgcgtatggccgtatgattttctttgcagatattgaggaagggaacgaagcggtcgcgtatcttctgcagttcggcggcatactcctcgtcggtgtattccagttgcttgaacgtgcgtcccgggtctacgtagttgcccggattgatgcgtactttctccgcatatcgggctgccacgtcggctaccttcgggctgaagtgtacatcggccacaagcggaaccatgtatccgtcactgcgcagtccgatgttgatgttcatcaggttttcggcttctttcaccccttgtgtggtgaggcggacgtactctccgccggcatctacgatgcgctttgcctgagccacacaagcttcggtgtcctgcgtggcggtattggtcatcgactggattcggatagggttggagcctcccaacggagcagccccgatgttcacttccgaagtttcccgccgggagtagttgaataaatccattttgttgtatgtaattggagtcgctttacgaccggacgatttattgcttacgagaggagtgtcgaaactcaccacagaggacacagagtaacactgagtgaatttaaaccattgattatccatattgataatttgtgaaaatctgtgtaatctgtggtgaaaagagttccgccttctcccgtaaccgtaaacggtaaatcgtccgtcataaatcttctcagtttgttttaaactcgtatttgatctctttcagttcttcattagcttttacgatcttctttttcagcccctccttataggcaatgaatttcgtttcgagttctttgttttccaatgaaagcatttgtacggcaaggatggcagcgttcaatgctccgttgatgcctacggttgccacagggattcccggaggcatctgtacgatggccagaagcgcatccattccgtcgagagacgacttgataggtacaccgattaccggcagcgaggtggaggcggcaatcacgcccggcaggtgggcggccatgccggcagcggcgattattactttaatgccgcgtgagcgggcattcttggcaaactcttccacagcttcgggagtgcggtgagccgaaagcgcgttcatttcgaacggcacgtgaaggtcattgagcaactgagcggccttctccataactggaaggtcggaagtgctacccatgatgatgcttacaattggggtcatattgttttaattatacgctaaatgttttctttctttagacttgcatggcttagaagttcaccacagaggacacagagggcacagagaatatttttctctttaatatcttaatgaaggaagagattaaaactctgtgttctctgtgtcctctgtggtgaggtctctttattcgttcaccaatgccttgtaactttctgcattcagcaggttgtcaaggtcggcagcattggccggtttcattttgatgagccagccttcgccgtatgggtctttattcaccagctcggggttttcttccagtgcggggttttgttccagcacttcgcctgcaacgggcaggaagaggtcggagatggtctttactacttcgatggtaccgaacacttcgttggcttccagggtttcaccttcggtaggaatgtcgacaaatacgatgtcgcccagttgttcctgtgcatagtcggtgatacctacataagctgtgtcgccctcaaggcggatccattcatgttcgttggtgtactttacattctgtgggaagttcataatgattagtttttaggattgatactatgtttaaaataaaaatatacggaacaatacgttgctgagcgggtggagcaccagcagcgagcagacgaaaccgacggtaaagccggcaaggacttcgcccagcgtgtgatgttgcaggatgatgcgtgccgagcctaatatccctgctatgaggatgaagaggcagagccaccacaccgggttgtagctgaagagcgcactgaacgataccagtccgcctacgataccgcccatgcctgccatgtgttcgctcagcttccacttcaggttgacaaagatgcagatgaccagcacgaccagcgaggccagtatgatgcctgtcatataccaggggatgttcagtttatgcatcatcatcaggcagaagacgtaggagatgatggtgagcaggatcggcacatagcgtttcttgcggtcgctcaggtcctggcgggcaaagccgttcactttgcggaacaggaagatggtcatggtgggcatcaggatggtgaagcagtagacaatgcccaatacgatgagtttgtactgcaacggcatgatgcgcaggtaagagaacaggaacaatacgaggaaggccagaaaggggatagagaatggagtcagtattcccgaaatgattctggccgtacggatcagtgtcctgtcagctatgatatgttgctctatcttctcttcttcagccattgggttttgttctttttgattatgcttttttattttctcagtctcgccaccgggatgttgagttgctggcggtacttggccaccgtccggcgtgcgatggggtatcctttttctttcagtatttcggccagttcatcgtcggtcagcggtttctttttgtcctcgccgtcgatgcattctttgaggattttccgtatctcacgtaccgacatctcttcgccgtctccggtggtatatccgtcgctgaagaagaacttcaggggataaatgccgtagttggtctgtacatatttgctgttgctcacgcgtgagatggtcgatatgtcgagtcccgtacgttcggccacgtctttgaggatcatcgggcggagcagcgactcgtcgccttcgaggaaaaaggggcgttgcaggtcgatgatggcctgcatggtggtcatcagcgtattctggcgttgcttcaccgcgtcgatgaagccttgcgcggcatccatcttctgtttgaggaacatcatggcctctttcgattctttggactggttggccttgttcttcgtatgttcctccaccatctcggtgaagtcgcggctcatgcgcagttccggcaggtttcggttgttgaggctgatgttgatggttccgtcgtcgtaggtatcgacgatgaagtcggggacgatctgttgcaggttccgtccgatggcttcacccaatgacgcacccgggcgcgggttgagcttggtgatctcttcgagtgccttgtagaagtactcttcgtccagtccgagcttcctgatgatcttctcccaatgcttccgagtgaattcttcgtagcactcgctgatgatctcctcttccgttgctaacagagggtccgcggtatgcggttgttttttccggcggatctggatcagcaggcattcttgcaggctgcgcgcgccgaggccgggaggatcgaagtcctgtacgattttcagggcttgttccagttcttcttccgtcgcgttgatgccggcatagatggccagttcgtcgccgatgctttcgagcgacttgcggagcaggccgtcattgtccagcgaaccgatcaggtattctgccagttcgcgctgatgttcggtcaggtcgcgttcgcccagttgctctctcaggatttcgtagaatgacgtggcgtccgagaatgggatctcttccgcctgctcgcctttggagcggttgttttcctggagtttatagtcggggatgtcatcttcggtcagatagtcgctcagagaatcatagtccgtatcgccttctgcttccccttcggcggtttcggcaggggtggtttcgtcggaggcgttttcttctttgccttcttcaagggcgggattctccagcagttcggcatgtacacggtcttccagttccacagccggtagctccagtagcttcactaccagaatttgctgcggtgagagcgtttgtatctgctgctgcgcctgcgattgtatctgacgggaaccttgtgccatacgttgaatgctttacgttttttttgtttctcgctacaaaagtaatgaattgttcgatatagcgaaatgatttatccgataaaaggagttaaaggaggaaacgggcggagaaggcggcggaattaaagctttccatcttctttgccaattcatcctttgtttatatctttgccttcataacttaaatacataccattatgttcagcaaagagacatatatgcagcgcagagccctgctgaaaaaaacattaggctccggagtattgttgtttttgggtaacgacgagtgcgggttgaactacgaggacaatacgttccgctatcgtcaggattccacctttctttattacttcggcctttcgtttgccggactttctgctataatcgacattgatgaagataaggaaattatatttggcgacgagcttaccatcgatcacatcgtgtggatgggtacacagccgacgctgaaggagaagagccagcgggtgggagtcagcatcaccatgccttcggcggacatcatcggctatctgcacaaggcggtgcaaaagggccaggccatccattacctgcctccttaccgtgccgagcataagctgaaactgatggactggctgggagtgcctcccgcacgccaggaagggtcagtgccctttatccgtgcggtgatcgcgcagcggagttacaagtcggccgaggaggttgtcgaaatcgagaaggcttgtgacatcacggcagatatgcaccttattgccatgcagatgctgcgccccgggatggtggagtgtgaaatagcagctgccatgcaagccgtggcgcaggccaatgaagccgaactttcgttcgctaccatcgctacggtgaacggacagacacttcacaaccactatcatggcaacacggtgaagccgggcgatctgttcctgatcgatgccggtgccgagacggagatgggatatgccggcgacatgtcgtccaccatccctgccgataagaagttcacgcagcggcagcgcgaggtttacgagatacagaacgccatgcatctggagtcggtgaaagcactccgtccgggcattccttatatggacgtgtacgatttgtcggcacgcgtgatggtcgaaggcctgaaaggactcggactgatgaagggaaatgccgaagacgccgtacgtgaaggcgcgcatgccctgttctatcctcacggattagggcacatgatggggctcgacgtgcacgatatggagaacctgggcgaactttgggtgggctacaacggacagcccaagagcacgcagttcggccgtaagtcgcagcgtcttgccataccgttggaaccgggctttgtacataccgttgagccgggcatttatttcatccccgagctgatagacctgtggaagggacagaagaagtttaccgactttatcaattacgataaagtggagacatacaaggacttcgggggcattcgtaacgaagaggattatctgattacggaaacgggggcccgccgtttaggaaagaagattccgctgacaccggacgaggtggaagcgctaagataattttttttcattgtagcattgctaagatgtgaatccaggtgatgcacgttttattttatttactcggatgaaaatccgattgtgattttaatttgtgttaatgttgggattgtccggatgtgaatccgggcaatctttttttttgccggttttaaaaaaaaagaaagaaaagagttgcttttccggctcgaacaggatacctttgtacgtgcttaaataacacatttttcatagccagtaatattgctaagatgtgaatccaagtaatttactttttatagactggttcagatagcgatctgagcatgacaatagatttaaattaatattgcagattgcccggatgcgaatccgggcaatctttttttgcccggttcttaaaaaaagaaagaaaagagttgcttttccggtttgaataaaatacctttgttagagatttaaggaatctgtttactacaaataaaaacgattgttgaaacagcgattcgtcgtttgagaaaaagaaacagataacagttttacatattaatagcagatatagtttaattttttttttttcataatattaccgctactaagatgtgaatccaagtgacggattttaagttttaagatttaatttgaaccttcttcaaattaatgattttgttatttgtcgattgcctggatgtgaatccgggcaatcctcttttttagccggttcttaaaaaaaacaaagaaaagaattgcttttttaaatttaactaaatacctttggaggacattaaataattttccattaacaacctttctaaaatcttaaaatcatgggtggactatactataacttggcgttacgaaatagtgatgtaagagataaagattctgaaaaactatattattgtgtcttgaagaacaggggtatggtagagcaggaaacattcgtcaattatctgagtcagatttccggggttcaagacgccttatgcctggcgatcatttctaagttgggagcggcgattacttatttcctgcaagacgggcagagcgtggatatccctcatttgggaattttcaatctgacggcaaacagttcgggggtaaaaacacttgaagaggcaaaagcgtcgcagataaagtctatcaatctgcgtttttcttctaaggaagaagctgacttagcattaagccgctgtacgctgacccggagtgtctcgatgaccaatacaaatgatgtaattaaagaaaaggatccaagtggtgaaatcgtggacgatcccactgcgtaatcagtataaaatatttcacatgtaactttagataagccgctggaaacagcggcttttttattacaaataagtttttctgcaaaattctcttccaagagccaatatgtcgtctcctaggcgacgacgaaacatcgtcttagatgacaatttttgtcgtctaagacgacaattttaaggagtctgatcgagcctttttatgaaatggtaatataattttataacatccttttctcggttttagtattaaaaactaacagatgtaaagcgctctttcttccgtccgatactttattttcaaatacttctcctgataccttttgtttttatccatcgatgtactacttttgtctgttgcagacagaaaataatgaaaaccattcacaaattattcaattcataaactatgcgtaaaataagcaatgtcctccgggcagcttcatgttgtaccttctcgctgctgatgtgtctcccggctgccgggcaggatgcatggagccaggcagactgtgtgaccctgctggacagtaccgcggtgactgtacagcccaatggctcaggtagtttcgtcgtgtaccggtcctttagagtgcagacccccaaaggggcagtaaacaatcatgtgatcaagtatgattacgatccgctgacggcgtttgcccgtttcaagcaggtcaccttgcaacgtgccaatggcgaaacagtgcaggtggatgtaacgaaaacctgcgattatgccgctcccgcacgggccatctactggggagcccgccagattatgatcgaactcggaagcctggaaccgggcgataccgtctcttacgaaatcagtaaaaaaggattcacttatgccctgctggccgggggagaggacgatgatgcgcgattcatcccgcccatgcggggacagttctatgacatcgttcccttctgggtggaccagcctacgcggcgcaaagtgtacaccgtcagtatgccgatggagaaggaactccagttccagttctataacggggcctgcgcctcgtcgatgcgttacgaagacggacgcaaggtgtatacctttgccaagaacgaggtgctccctttcgggcgtgaaccgaacatggtcgatctttttgatgaagctccgaagctgatgatgtcttccacgccgagatgggaagataaatcgctctggtttcatgacctgaacgaggcatacggcagtttcgacgccctgcccgaagcgcagcagaaggtgaacgaactcataaaaggtaaaaagacggagatggaaaagatcgccgtgctgacccattgggtggccgacaatatccgctacgccggtatcagcatgggcgagggggagggctttacgcttcacaatacgaagatgaactacaccgaccgttgcggcgtatgcaaggatattgccggcacgctgatctccttcctgcgtatggcaggtttcgaggcttatccggcgatgacgatggcgggaagccgcatcgagagcattccggccgatcatttcaaccattgcgtggcagtggtgaagttggcaaatgggatgtatatccctctcgatcctacctgggtgccgttctgccgcgagctgtggagcagcgccgaacagcaacagaactatctgccgggcattccgggaggttccgatttgtgcctgactcccgtgtcggctcccgaaaaccattatgtgcgcatcgtcgccgaaaataaactggacgcgaagggaacgctgcggggcacgttctcgatcactgccgagggacagtcggacagcagcatccgccgcatcttcacccaaggatggcagaccgaatggcaaagcacgatggaaagccagttgctcagtgtttccccccgggcccgcatgttgaaagtagattacggaagtgcgccgaaagattatcaggcgggacctatccgcatcacgttccgttacgagatccccgattatgcgcttgcgggcgacggcgaactgttgctgaaaccgatggtgatgaacaatctctataccagtgttctctcgttcctgcgcatcgacaccgatttggaaacccgccggtatggcttccgtgacgcttgttcacgtctggtggagctggacgaggtgattactttaccccggggataccgcttggcgggacagtcgcggagcgaacagaggaccagtccggcagctgactttgaggggtcgttgcggcaggatggcaacaagctggtgctgaagcagaaacttgccctgaagaagcgcatataccgggctgccgactgggaaggattccgttcggcggtgaatgcctacaagagctttgcggattatttgattgttaaaccttaaaaagattgccgtcacatgacaaaaatacatacccttctgctcctttgcctgtttgcgctggttcttccggtcgccggtcaggaagcggaattcaagaaaataaaagaaagctggacgctgcgggccgacggttcgcaggtctatcgtcacatgaaagccctgacactgtatacccatacagccatgaaccgcacctatggtgagtcgttcattacgtacgatccccgttatcagaccttggagatccacgaatcgtatacccggcagaaagacgggaacatcgtgaagacacccgataatgcttttgtcgaagttcttcctgcggcggcagccaatgccccggcattcaacgctctgcgggagatggtagtggtgcacaccgggctggaattaggtgctaccgtttatctggattactccatcacgagcaagcccggatatctgccggaaatcaacgtctgccgccagttggaacagtcttctccggtgaaagagtacgaaatcagcattaccgttccccaaggacaacggctggaatatgcactcgacaacctgaagtcgaaacctctcgtcaccgagaaagaaggcatgaagcaggttagctgggtactgaaaaacctccctgccctcagccgcgaaccgcaagtgtcggtgatcggcggtgagctgcctttgctgaccgctacgacggaacagaaaccgatggcgttcctctccgcacagtgggagcgggaggcggatgcccggcttcgcacccttgccggaaaactgactgccggcgcgaagagcgatgaagagaaagtgaaagccttacacagctacgtgatcgacaatctttattactcacctctcccgttgagcgaaaccgcttatcgcatccgtcccactgccgaggtgctccattcggcctacgccaccgaggccgagaaagcgaatctgctggctgcggtcctgagggctgccggcctgaaagccgagatcggggcggtctgcgttccgtccgcgaacaccgcatctttggggatgggcagcattcgcgaactgtttgtgtggaccgaagccggaggcaggcagcaagccctgtccctgaaaggcaaaaccccctccgccgtctcttggcagaaagatcatgcctacgtggccatgctgacacagccgtttgaactgaatcttccgtccgccgttctcaataaggaatataccttgcagcccgataaggcgaaagccaaagacggatatctggtcttcacactcccggcagagcggggaagcctcgccaattctcagtatgtccgctataacagcaggcgcacctccaaccttttgttgcccggagcggcggacgagactttcacctatctggcagagactcccgagggcatgcggctggctactccggcgatggagaagaagatagacaacgccgtaggcacgctaatcatttccatcctccccgaaggcggacagacgcgggtggtccggagcctgaaactgaaaaaacaaatgatccgtccggccgattatgccgctttccgtcagctgatgatagagtatggggcggtggacggacggacactcgtgtataaaagcaaataaataaaacccgataaacaaacagacccatgaaaaaacttatattactcttattctctgcactctttgtgctgtcggcccaggccggggatgtcctgcggctgatgacctacaacgtccgcaatgccagaggcatggacaatagctgcaactaccagcgtgtagccaatgtgatcaacaatgcccgtccggatgtcgttgctgttcaggaactggacagcatgaccgcccggagcaatgggacggatgtcctccgggaactggcggaacgcactcagctgcatccctacttcgctcctgccatcgattatgacgggggaaaatacggaatcggcctgctcgcaaaagaagctccgttgcgcctgcaaacctttgctttgccgggacgtgaagaggcgcggacgctgattgttgccgagtttcccgaatacatctttggctgcacacatctctcgctgacggaagaagacaggatgaagtcgctcgagatcctgaaatcggttgccgtttctgccgaaaagcccttcttccttgccggcgacttcaattccgatgccggttccggtttcatcaaagaactgaagaataccttccaggtactttccaaccccaagcaacctacttatcccgcttccgaaccgaaggagacgttggattacctgattgcgcttaaacaggaaaaacctactttcgttgttaattccgcccgggttatcgacgaaccgttggcgtccgatcaccgcccgttgttagtggaagtgcggatggcagtgtccgaagaccgcatctgtcgcaccaaaccctatctgcaaaacccggtcggaggcggaatcaccgtaatgtggcaaaccaacgtgccggcttattgctgggtggaatatggcacagacccctcaaacctgaagcgggcacgtactcttctcgacgggcaagtcgtttgcggcaacactctccataagattcgcctcgacagtttgcaacccggacagaagtattactatcgggcttgttcgcaggagattctgctttaccaggcttacaaaaaagtatttggtaatactgcccgtacagagcttaaagaatttaccttgccggccgatggtggagacagcttcacggccgtcgtcttcaatgacctgcacaagcagtcaaaaacctttcaggcgttgtgcagccagatcaagggggtggactatgatttcgtagtcttcaacggtgattgcgtggacgatcccgccaaccacgatcaggcaacggccttcatcagcgaactgaccgaaggagtggagggtgaccgcgttcctgttttcttcatgcggggcaaccatgaaatccggaatgcgtattcggtcgggctgcacagcctgttcgactatgtgggcgataagacttacggagccttcaactggggagacacgcgcatcgtaatgctcgactgcggtgaagataaacccgacgaccattgggtctattacggattgaacgactttacgaagttgcgtaatgaccaggtgggattcctcaagaaagaactcgcttccaaagagttcaggaaggccggcaagcggattctgattcatcacatcccgctttatggtaatgattacgagaacctgtgttcgggactttgggggaaactcctggagaaagctcccttcaatgtctgtctgaatgcgcatacacatgaatacgcttatcaccccaaaggcagtcttggcaataacttcccggtcattatcggcggtggttatagcatgaaaagcgcaacggtgatggtgatcgagaaaaagaaagatgtgcttaaagtgaaggtactcaacacccaaggagaagtgttgctggaacttacagtttaatgacaggctccgattcgataggcgtaaaaacaacagagggctgcatcaaaagccctctgttgttttttattatgtgtgcagctcgagtacgaaccggcttcctttagtgtagcttgtgtccaatgtcaggcttccgttcatcttggtagctatcagggcacagataggcagtcccagtccgtctccttccgtcaggtctttaatctccgtgaaaggtttgaacaggttctcttgtttttcggcaggaatgcccgtgccggtatccgagatgatgaactgatgtgtatgcgcgcctctcttcttgaagtcgaggaagatctttccgctttcggtatattctgctgcgttcttcagtaggtgaatcagtatccgttccaattgttccgggttggtcttgatctggagtttggcggcattcactacggtcgacacttcaggttgcaccagctctttcaccttatccatggtagcttcgcagaaagtatttacgttgatctccttcatctcgtaaggctcggtcagggagttctccaatgtagaaagctcctgtatgtcgttactgaacttcttcagggcggctacctgtccctgcatctgttgtgcctgttgaggcgccttgcccgatagttcggcagcagaagcggccagtgtatccagcgttggttccatttgtgcggagatgttctggatgaactttgttttcagttcgttgtgttcattggctatctgtacgctcttcttcagtttgcggtttccggcaatgaagcggagcagcacgatggcaacgaagatcagtccggctatcaggatgacgacaagcgtacatagcccgacaatcatatactgttttccggacagcgtatcgtctttttcctgaataatctgctggctttcgtcatatttgcgtttcaacacgttcagttcatcttgtgctgtcagcgctttcaccgagtcggtccagacaatgaagttctcatacgtgcgggccactaaggaggcattgtttgacttacggccgatggcaatcaggttcttatagcattcgtttaccttttcgtagttcttctgggctttatattgattgatcaatttccggaagcaggcgtccccttgtgcgttttggccgaaagtgtagtaatagtttgcctgcgtgtacaagaggttctcacttagcgaatcgttctttgcctggccggcggtttccgccagtttgtccaactgtgctttggcttgtgcggcattcttcagcccgatatacatttgtaatctctctttggtgatttgaaagcgcaacggatagaattgcttctgctccttttgttcgcccgcccagactaactgttccattcccctgcagaggtcgaatgcttctttataataattctcacgatggtaaagagcagctccctgaattccacattccacggctttcggatagttttcttgtgccgcgaaggcgccataggcttggatgaaaagataacgcgctttggtatattctttttgttccagactgctttgcgcttgtttcatcagttcatttgctctgttttgtgtgccttgtgcatcgacgattgtgctaaaacaaacgaggatggtcaggattaaagtcgatattttcatacgatatggttttaaacagtgacaaagttaaaaaatctttgtaagaacctctcatttaccccttttatttttcatttcttcctcaattcttcctttgagagttatgacaggcattgccggctgatggggtagtggatagtatttgataattcaagcatagattttacaaataatgctctctttcggagttttatttgtaaagtctatgtctgaaaaacataaggatgtgtctttttaatatttgaagctgcttcctcccaggaactctctaagaagtgaggtcggaggaatctccttatcctgtaccggagtgaaatatttgataaacttcagtagccggtatgcttcggcatattccgggcagttacgtggcacgctggtcaagatgggttcggcatggcagcggagcacggcaaattcaaataacagggcggagttgaacatcacgtcggcattctcctgataagggaaaatccacttgtcttctccggcacgcacgctgggccagcgcgaaatggtttcctgcgcagaatagccacgatagttgaagtcacggataatgcggcgcaaaagccggttgtccgtggtcggaatccagttatggtcgtccagggagatggttgtcagagcagatacatagattttatatttattctctgccgggatttgcggagtgagttccgggttcagggcatgaatcccttcaagaatcaataccgtatgttcgtcaatccgcagtttgtcgcctttatattctttctttcccagcatgaagttgtagcggggcagttctacttcctcaccacgcagcagagcttgcagttgcgcattgaataattccaggtcgagggcatagagcgattcataatcataattgccgttttcatccaatggagtttcttcccggtctacaaagtagttgtccagtgagatgggataaggctttaacccgtttgtcatcagctggatggagagccgcttgctgaaggtggttttgccggatgatgacggtccggagatcaataccagttttacacggttcccgttttctccccggtggaagatgctgtcggctatttgtgctattttcttttcctgcagtgcttctgccacatttatcaggtcggtggcatgtccttcttcacaggctatgttgaaatctcccacattgttcagccccataatgtagttccagcgcaaatgctctttgaagacatcgagcatcttctcttgtttcactacctcttccagtacggtcgggttttctttgttgggaatacgcagtaacagcccgtcgtagtacttaacgaggtcgaacagatgaataaatcccgtacttgggagtaaattaccataataatagtccgcagtgccacccaaagtataataataggtatagatggagccggaagactcaagcagtttcactttgtcattcatgccccgctcgctgaatacacgtacggcttcagtggtgtggcattcgatacggtggtaagtgatattctccgtaatgatttcctgcatgcgtttctttatttgcgacacatcctccagagtgatggcccggccgatgcgcaaattgcagaagtatcccttggatacggggtgctctacaaaaagtttgccattcggaaagagttcgctgactgccttgtagagtacaaaacaaagagaacgtacatatgtacgcatccccgaagaatctcttacatccagaaactctacatccttattgttatatacacgaaagttgagtccttcagaacgattatttactttggcactgactacctgataaggaaaattaagattgaaaccgtaataaatatccaaaagtgagcttccaatagggaattctttagaaatattattatttttgcaatatatttgtaacatctgtttcatttcacgtcgtttaggggtgaatagtacggataaatatatcacataattgctaagaagacaaacaaccactaaaataattatagatggaatattctttttatgattttttaaagctcattggctcattaggactttttctttatggaatgaaaatcatgagcgagggcttacagaaagtcgcaggtgacagattgcgaggaatcctgacagcaatgaccacgaaccgggtaacgggagttttaacaggagtgttgatcaccgcccttatccagtcttcttcggcaacgacggtgatggtggtcagttttgtaaatgccggtttgctgactttggccgagtccattagtgtgataatgggtgccaatatcggtacgacagtcaccgcctggatcatttccatttttgggtttaaagttgatatggctgcttttgccctccctctgttagccattgcccttccccttatcttttccggtaaaagtaaccgtaagtctgtcggtgaattcatttttggtttttctttcctctttatggggctttcgtatcttaaagcaaacgcgcccgacctgaatgctaatccggaaatgcttgctttcgtgcagaactataccgatatgggattcttctccgttctgctctttctatttatcggtactattctcacaatgatcgttcaggcgtctgccgcaacgatggctattactttaattatgtgcgccaacggatggattagcctggagcttggtgctgcattggtgctgggtgagaatatcggaaccacgattacagcaaacctggctgccctgacagccaattcgcaagcgaaacgagctgctttggcccatttcgttttcaacgttttcggtgtgatctgggtattgattatttttcatccctttatggtatttgtcaattgggtggtggatagtttcttccatccgggaagtgccgaagtagccatttcttataagttgtctgctttccactctatctttaatatatgtaacgtctgcctgctgatttggggagtgaaactgattgaacgtaccgtgtgtgccattattcgtccgaaagaagaagacgaagagccacgtttgcgtttcattaccggtggcatgctttccacggccgaactttcaatacttcaggcccgcaaggaaatccatttgttctccgaacgtattcaccgtatgttcggcatggtgcaggatctgctgcatacggaaaaagatgacgacttcaataaattattcagccggattgaaaagtatgagaatatcagcgataatatggagttggagatagccaattacttgaatcaagtgtccgagggacgattaagttcggaaagtaagcttcagatacgtgccatgcttcgtgaggtgactgagattgaaagcattggcgacagttgttataacctggcacgtaccatcagccgaaagcgtcagaccaatcaggattttacagagaaacagtatgaacacattcacttcatgatgaagctgacgaacgatgccctgtcacaaatgattgtcgtggttgagaaacccgagcatcagagtatcgatgtcaataagtcgttcaatattgaaaatgaaataaataactatcgtaatcaactgaagaatcagaacattctggatgtgaacaataaagaatatgattatcagatgggtgtttattatatggatattattgccgaatgcgagaagcttggtgactatgtggtaaatgtagtggaagcaagcagtgacgtaaaggaaaagaaagcatcttaacaggtcgatgaaccgtgaacgatgaacgataaatgatgaataaagtgtgattggtacacttacggttcatcgtttattgttcatcgttcaaaaacgtccgttgtttataagttatccattatacggttcgaaatcttctttcccaactccacaaagggggcatacccaatcatcagggatatcttcaaactgtgttcctggttcgattccgctttccggatcacctgtctccggatcgtaaatataatcacaaacggtgcaaatgtacttcatgtcgtctcttttttttaagtttatgcaaatataacaaaaggattggatatattgttcacttattttttctttttggttaataaaacactacctttgccataacaacaaagcattaatcaagcagttataaattatgatgtggcagattgtattaataggggtatgtgtctcttttctgggagcatttctgtgggaaagaagaaaacgtaagtttatgcaatctgcatcagaccggaaactggagaatgtaaatcgcttgtttgatgctatcctaacgcatattcatgcttatgtccttgttatcgattctgattttaaagtcctgaaaacaaattattatgatttgactcacctcaatcctgatggtaaagaaaagcgcgtcggtgatttattgcaatgtcagaatgcattgtctgccaagggaggatgcggaacccatgctttttgtcaggaatgtcctgtaagaggggctatcggggctgcttttcgtcagaagagcgagtttaccgatctgcagtcttcactgaatattgccataggcgaagatgaatttataaaatgcaacgtaatgatttcgggagtttttatgactctggatggtgaagaccgtatggtactgacggtgcatgacatcacttccatcaaacatacggaagaggcgctggccgaggctaaggagaaagccgaaaacgccgatcgttccaagtcagccttccttgccaacatgagccatgagatccgtactccattgaatgccatcgtcggtttctccgaactgctggctgctgccaccgaggaaaaggaaaagcagaaatatctggaaatactccatacgaatagtgaactcctattgcaattggtgaatgacattctcgatttatcgaagattgaggctggtacattagagtttgtgtattccgacgtagacatcaacctgctgctggccgatctggaacagttgttccacatgaagatcggttatgattcgcctgtacagataattaccgaggccggattaccctcatgcatggttcattccgaccggaaccgtatcgcccaggttgtatccaattttgtttctaatgcaatcaagtttaccacagaaggcagcattcgtatcggatataagccttgcgagaatggacttcggttttatgtcaccgataccggttcgggcatttcagcagataagctgggaggtgtattcgaccgtttcgtacgtctgcagagtgataaaaacggcaccgggctgggactttccatctgtaagacgattgtgaataaactgggtggggaaatcggagctgaatcggtggtaggccaggggagtactttctggtttaccttgcccgaacattcggatatcaaacctaaggtaattattgaaaaagaacaggagagaccgtcttctgttgtgtcagttcctgccgcgggggtaaacggtgataagaaactgacagtattggtggcagaagatatggaagataattatcgcctttgtgaagctatccttgcttcccgttacgaactctattgggcacataatggtgaagaagccatttcccttttcctgaaaaaccagcccgatatcatcttgatggatattcgtatgcccgaggtgaacggttatgaagctacggaggctatccggcaaatgtcggctactgtgcctatcattgctctcacagcttttgcttacgaagaagaccgccaaaagattatgcagagtggctttaccgatttcctgacgaagcctatttcatcgagaatcttgttgggaaaactggaatccttaaaaaagatttaagaaacattctataccggatttatgttgtatttttgcaacctctaatttaatgtatgtatctgcatgactgcaaagaacgacgattattttcatttgggccttactgatcaagaagtcctccaaagccgggagaaacatggtgttaacctgctgacgccacccaagcgtccttctctcctcaaactctatctggaaaaatttgaagatcctgttgtacgggtattactcgttgcggctgtgttctcccttatcatctcgattattgagaatgaatatgctgaaaccatcggtatcatagctgctatcctgctggcaaccggcattggtttctattttgaatatgatgcgaacaaaaagtttgatttgctgaatgctgtcaatgaagagactttggtaaaggtgattcgtaatgggcgcattcaggagattccccgtaaggatgtggtagtcggtgatattgtggtactggaaaccggtgaggagatccctgccgatggagaactgatagaagccatctccttacaggtgaatgaatcgaacctgaccggagagccggtaattaataaaacaacggtagaggcggattttgatgaagaagctacgtatgcctccaatctggtgatgcgtggcacgactgtggtcgacggtcacggatcgatgaaagtacttcgtgtgggagatgccacggagattgggaaagtggcacgtcagagtacggagcagagcacggaacctacgccccttaatatccagttgactaagctggctaacctgataggtaaaatcggttttaccgtagcggggcttgctttccttattttctttataaaagatgtagtactctattttgattttggagctttgaatggctggtatgactggttgccggtgttggagcgtaccctgaaatacttcatgatggcagtcaccttgattgtggtcgccgtccccgaagggttacctatgagcgtaacgctcagtctggccctgaatatgcgccgtatgcttgccaccaataatctggttcgtaagatgcacgcttgcgaaacgatgggagccattaccgtgatttgtacagataagaccggtacgttgacgcagaacctgatgcaggtgcacgagcctaacttctatggtttgaaggatggcgggaagctggcagatgacaatatcagcaaattgatagcagagggaatcagtgctaactcgactgcttttcttgaagagacgggagagggagaaaagccaaaaggggtgggcaatcctactgaggttgctttgttgttgtggctgaacggtcagaaccgtaactatcttgaactcagagaaagggcgcaggtactcgaccaattgacgttctctaccgagcgtaagtttatggctactttggtgaagtctccgctgataggtaagaaagtgctatatataaaaggtgcgcctgagattgtgcttggcaaatgcaaagaggtgattcttgacggtcgtcgtgtggatagtgtggaataccgttccactgtcgaagcgcagttgctgagttatcagaatatggctatgcgtacacttggttttgcattccgcatagtagaggacaacgaaccggacgattgtgtggcccttgtgtcggaaaacaacctgaacttccttggtgtggttgctatttccgatcctatacgccccgatgtacccgtagcggtggctaagtgccagtcggcaggtatcggtattaagattgttaccggagatactccgggcacagcaactgagattgcacgccagatcggattgtggaaaccggaagatacggagcgtaaccgtataacgggagttgctttcgccgaactgagcgatgaagaagccctgaatagagtgatggatctgaaaatcatgtcccgcgcccgtcctaccgacaagcagcgcctggtgcagttgctccagcagaaaggagccgtagtagctgtgaccggtgacggaaccaatgatgccccggcacttaatcatgcacaggtgggactttcaatgggtaccggaacttccgtagccaaagaggccagtgatatcaccttactcgatgattctttcaacagtatcggaaccgccgtgatgtgggggcgttcgctgtacaagaacatccagcgtttcattgtattccagttgaccattaactttgtggcacttctcatcgtattgctcggttctattgtaggaacggagttgccgctgactgttactcaaatgttatgggtaaacctcattatggatacgtttgccgcattagctctggcctctattccgccaagcgaaagcgttatgaatgataaaccacgccgtagtactgattttattatcagcaaagcgatgcggcaaaatatattcggtgtcggtacagtctttctggtggtgctgatggcaatgatatattacttcacaaatgccgatggaggaatgacggtacagcggttgaccgttttcttcaccttctttgtgatgctccagttctggaacctgttcaacgcccgtgtgtttggcactaccgactcagcattcaaaggtcttgcgaaatcatatggtatggagctgatagtactggctattctgggcggacagttcctcattgtacagttcggtggggctgtattccgtacagagccgcttgactggcaaacatggcttatcatcatcggttcttcctctctcgtcttatggattggtgaactgatccgctttgtcaaacgtttaactcagaaatgaaataagaggggtctcaccccatcctttctcaaaggaagaggggatggggtgagaccttaaaacaatatagagatgaaaagaaaaggaattaaaaaccttatttttgattttggtggtgtattgatcaatctcgaccgtcagcgttgtgtggagaacttccggaagttgggattagagaaagtagacgaattgttaggtatgtattctcagcaagggatctttatgcagcatgaaaaaggattgatctcgtcggctgaatttcgtgagaatatccgtgggctgctcacaaaaaaagtgactgacgagcaaatcgatgctgcctggaatagttttctggtagatatccctcgctttaaactcgacatgttgctgaagctccgcgaaaaatatgtggtctatctgctgagcaataccaacgagatacattggaagtgggcatgcgagcacgcatttccgtatcggggcttccgtgtggaagactattttgagaagatgtacctttcgtatgaaatgaaaatggtgaagcctgccgaagagattttccggggggtacttgaagacgcaaaccttgatccgcacgaaacttttttcattgatgactccgaggccaactgccagggagcccaggcattgggtatctctacttatacggtaaaacccggtgaagactggaggccactttttgccggaaataaataatttagaagacatagcatgcagataatccataatataccggcatttacacccgaaccttgtgtagctaccatcggctttttcgacggagtacatacagggcatcgtttcctgatcaagcaagtcagagagctggctgccgctcgtggattgcgctctgcattaattaccttccctattcatccccgtaaggtgatgaaagcggattatcgtccggaactgctgactactccggaagaaaagcggacactgctcgaggaaacaggggtggactattgtttcatgcttgactttacgcaggaagtatcgcgcctgactgcccgtgagtttatgtctgatcttttaagagaccgttatcgggtgcagacactcgtcatcggctatgaccatcgttttgggcacaaccgtagtgaaggtttcgaagactattgccgttatggttccgagatgggcatagaggtaatccgcgctcgtgcctgtgtgtgtgatgatcttcatgtaagctcttccgtcattcgcaagatgctgcatcagggtgaagtcgatatggcgtcccgttgtctgggttacgactattttctggatggtacggtggtgagtggctatcaagtgggacgtaagatcggatttcctacagccaacctcagtgtggacgatcctgataagttgattcctgccgatggtgtttatgcggttcatgtcacattcgatgggcgtacctataacggtatgttgaatatcggtacccgccccacgataggaaatggtcccgagcgttcgatagaagtgaacatccttcattttcattcaaatatttacgataagtttatccgtatttcttttgtgaagtatctccgtccggaactgaagttcgatgggattgacgggctgatagctcaacttcatcgggatgcggccgaagtagaagctcttttggggaataaataaaatgtcaattgacattttgtatttcctgtttgcctttgagccggctatatgcgcccctcttaatatcgaaaaacatactatatttattgtttatcgataaataattgtcggatttcttgtttaagtggaaattaatatcaatctttgcatatcgaaaaacgataaattattattgaataacataacgaatctccaaagtcaatcttatgagaaagtcattgatgagcattacgatgttggtagtatccatctctatgttagctttgtttgtgtgtagctctgttttgcacggacatggtacaaatcaccctgctactgaaacggtagtcaattaaaaccgttatctttgtacatatttaaaacagagaaccgaatgaaaacagcgatcaaattaattcttatttatctggggatccagcttgtctgtggtgggctgataggtattccttttactgttgttgcccgtatgaatggtgggaatatggatgccacccggatttcggagttgacactggctccttcgatgttactttccatggcagtgatgtttttttatttatggaaagcccggtacatacctaagaataaaatgagctggtcattcgtttcgttaccgtttcttacggtcacttttctgataggcttgtcgatgactgttctgatggacttgttaactgctgttttatcttgggtgcctgatgttctggaacaacagtttaatgctttacagtccggttggttgggaattgtggccatcacgttgttgggaccggttcttgaggaacttttattccgtggtggtgttactaaggcgttgcttgaacgatattctccccggaaagcgatttttctttccgcacttcttttcggaatattccatttgaatccggctcaggtagttgccgccttcttcggaggactgctgttggcgtgggtttattaccggacgcggagcctgatcccctgtatcctgatacacattgtgaataacagcctttctgtgatattgagcctgacctatcccgatgcggatacgattagcgatgtgaccgatactacatcttattacatactgatagctgtggccgctatgctgttcgttggttgcttcctacggataaagcaggttacgattccgggagtgtggagaaagagtgagtgaaactgaactatgaagattgaaaaacaagtcataatatgaaaagaagattgaacatactatgtttactggtatttctggtattctgttattcggtattcaacatggggcgtgatttcggtcatggcttttccgagggcatgaagataagccattccggcaatgaaagtgtggaacaggctattaaccttcgcattgctacgttgatgcccgaagatttttcgtcgtttaaagattctgtttacaatgaacggacccaatcttatgtgcctgttgcttacacacagttgatcacgaatgtaaaagtggacaggagcacctggctgatggttgcgcaagtgctctccgggcttcttgccattttggccgtaatagcatctacggtgctgtttgtgcagttgattgtatctatcaataaatcggatatttttaattggaagaatgttcgtaggttacgttggttgggagtcaccctgttgctgagttttattagtgaagcggtgccggctttgatgaatgattatgaactgtcctcagtcttttcattatccggctactctatggagacaagtattgactctgtgatgctggtcattttaggactggtttcgctgattgtaggcgaagtattcgccatcgggttaaagatgaaagaggagcaagaccttactatctgaatccggacactgaaaaattaatggaattatggctataatagtaaaccttgacattatgatggcccgaagaaagatatctttgggggagttggcggagaagatagacattacacctgccaacctttctatcctgaaaacgggaaaggccaaagcaattcgtttttctacccttgaggcaatctgcaaagtactcgattgccaaccgggggatattctggaatatcaagtggatgaaaaagatccttgatttgccacagcggaccttctgtgtgtccactgtggcgatatagaatgaggagattaaccttttgtccctttggctttgaatgccaatgcgtacattcgcatttgttttaccattgatagcagaccgttgctgcgggtgggcgataaatgatctttcagcccgatgcggtcgatgaagtaaagttccgaattcagaatctcgtccggtgtatgtcccgaaacaacttttatcagcagggcgataataccttttacgatcagtgcatcactttctgctttgaagattacctttccatctacctcgtctgcctgaagccacacacggctctggcaaccttcaatcaaattctgttccgttttatatttctcgtcaagcggttcttgttcgtttcctaaatcgataagcaactggtagcggtccatccagtcgtcaaagtcactgaactcggcaatgacttcgtcttgtaattcgttgattgtcatattgaataattatttctcgttatagataacttccagtacggtctggcccacggctttgagtgtcgatttgtcgataacatccatgttgtcgtttacggtatgccaagtcggtccgaagctggacagttcacaattttcgtcattcggaatgatgtcgatagtcgggatgccggccagccgattgataaacagatggtcgtcagtgatctgcccacctgtttcgttaataaagtaacgtccgtaaccagcgtcgttagccttcttccatacctttttgttgattccacgggcaaacttctccgagtacacctccttaaagaaagtggcatctttgccgcctaccatatcgagcaagataccgaaacgggcattatagccttccacatgcggattgcgtgcccaatattgtgcaccgagacaccattgctcctctaaatgctctcctttatagaattggggagcgccataatcttctgcgtccaaaaagataatatcgattcccagttccggttgctgctgattgatcagtcgggctatttcaagcaacacgcccacaccgctcgccccgtcgttggcacctaatatcggtgtgtggtgattcttctcgttgggatcattgtctgcccacggacgtgtatcccagtgtgcaaaaagggcaatgcgttttttgctttcgggcttgaatgaaccgatgatattgcgtgctttcagcagcgtgccgtcataggcgggcagttccacattctggttagtcactttggccccatgttctgccagcttagcagccagatattctccacatgctgcatgtcctttactgttcggattgcgagggccgaagtccacttgtgcctgtatgtatttataggcgctgtctgcatcgaattgtggtgctttcacggttatattcttttcaggctcctgaactgaattggttttgttgttgttcgttccgcaagaaaaggcggataacaaaataaaagctgtcagtaatagcatagaatttcttttcataattatgcttttggggttaaggcctcaaaattagtcattttcgcagtagggtaggtcagataggagggtttattaacaattctactcctttctttccggatataagttctacttccgccccattgatcagtggcagattttccgttacatgccctacggggaaatcaaagcagatcggataattatactcttctaccagatcgaagagtgcaccataaaggtctttctttatggcacgatcttcttcgtattcggtaaactgtccgatgataaggcctgacaacttctcaagtacgccccctaatttcaggttatacatcatgcgctcgatggcataaggacgttcgcccacgtcctcgataaacaggattgtcccttcgggaggtatgtcgtatggagttccccgaaggccgtggaatactgccatattgccaccacgcagaatacccttggctgtgccgagtcggttcaacttgtgacgcttacatttatatgcaggcagtttaccgaaaagtatatccctcaggtacagtgaacacggatcgtcggccgcttctactgcgagatggcgtgccataggagcatgtaacgaagcaaacccgttgtactgaaatagattatggagcgctgtgatatcactgaatccgatcatccacttcgggtgttcacggaaacgggtgaagtcgagccgttcaataagatgaaccgctccgtagccgccacggctacataaaatcgccttaatttctttgtcatccattgctgtctgaaagtccgaagcgcgctgccggatggtgccggcatagcatccccaggagctacggacgtgtttccccatttcagggaccagtccccaagacgccagttgcgccttggcacctctcagaaacatattgtctatcttgcccgaaggcgatacgatggcaactttatcgccttcgtgcaggaatggggggaattgtatcttcattcagtgaatttgttttagtttatttcttctggtagaattttacccagtctacatgcatttccacaggaagttctttcgggtctacagctcctacccacgagccacccagttgcatgtcgatcagcagatagaaaggctgatcgaaaggaaattgcccttctttgtctgtttcgatgcggggataggtgaaagtatgcgtatcattgatatagaatgcaatgctgtccggatacatttctaccgaatatacattgtagtcatcgggattgatcgtacctacggagtgtgacaacggattgtctttgatgcccagattgtatgtatagttggtatgtatagtctggtaagcgattgtgtcgtgattcagacgttccataatatcgatttctccacccatcggccagggagcatctaccggaagcatccagatagccggccattcgccgcgtgcaccgttcaacttggcacgtatctccagacgcccgttgctgaatgcctttttccctttggtataaatccctccggtcagatagggtgctgtgtcattgggctggctgtaattgatgataccccgcagcaccatattgccgtcacgcatatcgaaacaagagtcgaagtctgtcatatagttattccagtccgatttgccacgtggtattttgctccatacctgtgggtcaaagcctgttttttggtcgaaattatcttcccaaaccaatgtccactggtcaggcgaatgacgttggcacgatgaaaagcctgaactgatacacagcaggcagaaaagagcgaaaaaagtttttgttttcatggttctgtttgattataggtgtttaacaggatacaaatttacattaaaaaacgaaattacctgcatccgtagaaatgaaagcgttgtataatatcaaaatgttatccggtttacccattttttcagtataccatgatgtacttctcgatcctttttctgatatttgctaaaaatctaacgttatggaacctattagaaacttcgaccaactgacagaacacctaaaaaccttaaaccgacggaaacggattgccgttgtctgtgccaatgatccgaatacagaatatgccattgcccgtgcacttgacgagggtattgcagaatttctgatgattggtgactcagccatccttcaaaagtatcctaccttgcaaaggtatccggattatgtgaagaccatccatattgaagatcccgatgaggcagcgcgtgaagcggtccgcattgtccgggaagggggggccgacattttgatgaaagggattattaatactgacaacctgcttcatgctattcttgacaaggagaaagggctactacccaaaggaaagatcctgactcacctggctgtaatgcagattccgacgtatgataaattattgttcttttcggatgcggctgttattccccggcccactttacaacaacgtattgagatggtttggtacgccatctgtacctgccggaggtttgggatagagcagccgcgcatctctttgattcattgtacggagaaggtaagtgccaagttcccccattctcttgattatgttaatatcgtggagttggccgaagccggagagtttggcaatgttattattgatggcccgttggatgttcgtacttcctgcgagcaggccagcggggatattaaaggaattgtatcgcctatcaacgggcaggcagatgtattgatattccctaatatcgagtcggccaatgctttttataagtctgtttcattatttgccaaggccgatatggcaggattgctgcaaggccccatttgtccggtggtgctaccgtcacgtagtgattccggactttccaagtattatagcattgcgatggcatgcctgacggcttctacccggtcggcagagggaggaagatgctccgaatgatgatcataattaaactaagaatatggataaactgaatgcaatccccacttccccttctgcaaggaatggacggagtgaaagggtccttgttatcaatcccggttccacttcaacaaagattgccgtttatgaagacgaaactcctttgttggtacgcaacatccgccatacagtagaagagttgtctgccttcccccaggtgatcgaccagtttgagtttcgtaaatcacttgtcctccgggagttggaggcaaatgatattcctttccggttcgatgctgtcattggacgcggaggtttggtgaagcctattcccggtggagtttatgaggttaacgaagctatgaagcgggataccctccatgccatgcgtacgcatgcctgcaatctgggaggtttgatagccgatgaattggccgcagctttacccgggtgccgggcgtttattgcagatccgggtgtggtggacgaactggaagaggttgcccgcattaccggttcgcccttgatgccgcgtatcactatctggcatgcactgaatcagaaagctattgcccgtcgttatgctgccgaacatggcactcattatgaagatcttgatttgattgtctgccatttgggaggaggcatttccgttgcggtccatcgtcatgggcgtgcagtcgatgccaataatgcactggatggagaaggtcctttctcacccgaaagagccggaactcttcccgccggacaactgatagacctctgtttcagcgggaaattcaccaaagatgaattgaagaaacgaatttcgggccgtgccgggcttaccgcccatttgggaactactgatattcctgccgttattcagtccattgaggcaggtgatgatcatgcccggttggtgctcgatgccatgatctataatgtggccaaaagtatcggtgctgcctctactgttttgtatggaaaggtagacgccatcctgctgaccggaggcattgcctattctgattacgtaatttcccgtttaagggaacgtatttctttccttgctcccgtcttcgtgtatccgggagaagatgagatggaggctttggcattgaatgctttgggtgctttaaggggagaacttccggtacaggtttatcagtgattttagagcttgatgtagtataggtgtttgtgtagggccagaaagcctgttctttaaagcgtcaggcttactggcttctggcttcatctggcaactcgctagagattgcgaacacatcggacagaaacaccggactgcctgttaccgttaccgtctacgaagacgtcattattgcggatgtaaagaccgtagcctgaattgccgttgaggtcactactccagtagtagctgcctgtgccatcggtataagtggtagcagcagtaccactacctttgttgccgtctcgccagcctgcagcaggcaaaaatagaccgatcgagctattcataaaccacataccttgggtaccgttatactttaccaattgcttcttactacagcgggagagacttgtgaattcatttcttgttggagtacgccaaccgctaccgtatttactttcgtcaagacgtgtacaaggatcgacagcaccataacctgtataaccggatgatacgtatacattcttccatatataatagtaaccgtaatcggtagtagaagaagcccatgtcagattgtagttgctttgggaattgagattaccttcagcccatcggagttttgataagatggtcttatcgtttgctgtacacccattttgtgtgagattaatatcaccgtagggtacattaattccgatggctttcttaaactgtattttcatcgtatagctttttccctctttcagttgcacgctttgggtggaggcccgtagtcatccgctatgcggctgattatgggcaaaccagaaaagagaagttccaaacgtgggcgggattgcaatggtcatcatccggagcttcggcattgccgaaacaacctccttcttccgtattgcagttccttccttttaccgtttgtcccggcagtccgttgctaacccgttcccccctgtcacttgtggcagggagataggaatacggttttgcaagcaaaaccgtatggtttgttttactttccgtactgcccttttcctagttttctgcctcccttaatgtgcgtttttcatagccccatctgagaccctttgtttttgaacggcaaatttatttcggtggatggatacgaaagagttccggtcttcgccctttgtcccgaaaaaaataacgccggacggcttcgctgtccccaacattttttgtcgtccaaaacttttcttaatccctccttccttattgttgtgtgccgtaaaaaaaaggctcataaactcagatggggcatgaaagctcaaaaaaaaagtcggcagaaagaaaaggccatcccggaaaggggttttaaaaaaaggtctttaaatctagctgaagcataaaattagaagtttaacaaactaagtagcagaagtatatgcaaatcattcaatttgttttttcggtcatcatcgctctttgtgcagtggctatgtttgtcggagcggtaataacgccaagtccgataaaggttgtgtcggttacgttgttggctcttatttgcctattctccttgtttctcgtgaaattggcttattgtgaaatgaaatctaaaaatgatatactatgaaagtgtcagaacaatttaaaagtaccatcaaggcataccttgataatatggcagcggtggatagtctgtttgctccagtctatcaaaaacctacaaagaatatagataattgcattacctatattttaaaccaagtgaagaaaagcggttgctgtggttttagtgatgatgaaatttttggtatggcgttgcactattatcaggaagataatattgaggtgggtagcccattgaaatgtaatgtagtcgtaaatcatcatgttgaattgtcagaggaagaaaagaaagcggctcgtgaggctgctatcaaaaaattgcaggaggaagaattggcaaagttgaagaagcgtcaacaagctaaacgtgagaacaacaccgaagtacaaacccagttaactcttttttgatatgaaacccaagacaaaattacaaatggaaatcgtgaatgggagcaggaagttagctcccgtttcagaggctcaaaagcgttatgcctataaacattgctttgtgcattatttcaagcgtgatgcaaaggggaattgcttttgtttggattgtgggcatacatggcgggataaggaagataagaaaaactgtaaatgtcctcattgcggtatgaacctgaaattggagaatagcaggaaaaggacggctgtatataaagaatatttttgtgtgattactacatacaagcaatatcaagttatccgtttttttatggtggactgccggctgaaaaaagggtctccggctaattactttataattgaggcggtacagtgttggatgaataaagagggcaagacagaaacgctgtctttgctgcggggcatgtctatattttattacgatgcatggatatatggaagttctttggaattgcgtaagcggaatgtgcatcatgaccgtatttatgatatttgcccggcagttatctatccgagaatgaaagtgatacccgaacttacgaggaatggatttaagggtgccttttatgatatttgtccgagttccttctttatgacattattaactgataatcggatggagatattatataaggcagggcaaatgaatttgttcttgagatttttagagagaaaatacggtatagataagtattggacgtatgtaaaaatctgtttaagacatgactatgtgatacatgatgcggacttgtggctggactatgtggatatgctgatagaaaataaattggatgcgagaaatcctcattatttgtgtccgttgaatgtagaagaagcgcatgattgggtgatggggaaatgtaagaaaaaatattctgaaaaggatgaaaaagactatattgctgccaaatcacgtttctttaatctttcgtttgcggatggaaatattatggttcgggtattggaaagcctttcggacttttacaaagagggaaagttgctgcatcattgtgtattcagcaacgcctattataagagagaagattcgttgataatgtcggcaacggtggatggaaggcgcatggaaacggtggagttttcacttagcaggatggaggtgtgccagtgtcgtggaaagtctaaccaattatcagcctatcatgaccggattctgaatttggtacgggataatataccgttgataagggaaaggatggtagtgtaatgaatagcccacacatctaaatgtgtgggagttcttttttggaagacgcccaaaaaagaaccccaaaaaacgttgtcgctacacatcgttacgctcggattatttgcttgtcggctttagtttgccgatacatttttccatgtcgggggacaataggaaagaagccgtctttttctgctgcacccctgagtgtggctggacgatggcatacctgcattttaatatcttgccgataacttccgtactgtcacggtgcaggtacatggctttcatggcatccgttgctttcaggcttttttcggcttccatataggcggaaaaggacggtttgaataaggcacggggactttccgctttctgtatgacagcggataattgtgcgcttttgttgttcaggtagcacaggctgtccgatacggtgacgtcttctgtttccaacacttccagtagttcgaactttaaatccgtccaggtgccgtgagaatctgtctgaacccattccgcaatggccttctcatagccgggtttgctgcatgaggaaaaggcaatgagcagcatacaaaaaaataaatgcttgatattcatattgatctgattttataggttgtcgtattatgtgatggagcaaatctatgaggttactggccgtcctccgtggaggaacagatgccacacgagattttcagatcatcgttccaatccttgttttccgaaagttcgacgttcttcagtttccgtaccttgttgcggagttcatcgttactcaggctctcgacatcagtcgtatcgccatgaaagtaacgatgcagccatagagtgtacttgtgcccttgtttgtcgttgtcaaagatgctccggagctcctttacctggttcttgtcaagaatcaggcgtaatagcctcatttgtccttccgtgaatgtcccttccgtagatacatatacaagattgaggtcgtttccggaatggcgtaattgatagtgggagatacagtctataaatgactccccaatgtagagaatgtctatcgggcggcttttgtcatggttgctggtcgccagacagtcgaacttgccaccgataatccctttgaatgtttcatttcgttgagaaatggcttgcacaccgttttcattgtacatcttgatgcacacgttgcggtaaacactccctttgttctttacctcacggataaagaaagtgtctttgaagaaccggctttcaatgctttctttcaggatacctcttttctggagataattgcccttgtagggttgtagctggctcaagtagaattgaagttcgtccgctctcatgcttgtgttacctacttcataccggcttttttcgggtgtcgtgatgcggttggtgttgatgtagttctgaaggatctcccccacctcgcgcaaggacggcatttttccggttgtttcaaatagatgttcctgcatcagatccatgatactgcggccacgcacgctgtcactatgcacgtcccaataggtgtattggttctgcgagttccgcttgatgacgatggtatgcgttccgttgctcattttgggacaggagttggaagagccttccacgattttccatcctagttccagcaggaaatcgggcagagaaatggttgtttttatctgattgaaatcgactttcataacgttgactggattagttgaatctcattttatctgagcttagattataaatgagaaagattatctttcataaagataagaaatatcatctaaatatggaagagaaagtatatgttttttgattcgtctgcatttttatttcaaggtactgtaaaccaaatcaacagtagtgtctataccgggaacggcctccaactgtttgctctggttgaatacgctttccccgtctttttttatctgcatggtgatgatagcactctcttttgaatagagaatgccttgcacggtaatttggctgacaggcttttccgtgctgtattccgctttatcggtgaaactctcatctacggaagctgcggaggtaccggtgcgttcgttcctgaatctcacgccgtcaagattatatatatgcacactgcctttgggtgaggaaccggttacggctacggtgatgtgatacatgccggctttgtctgtttccgattggatttcctctttgttgcatgaagcggccaataagcaggctgccgctaataatgaatgaatttttctcatggtaggattcttttgttgaatgttatcggatgattttttgttctgtcttgtgtgtcccggttggcggaactgctgacttttcttttaatttgtcctctatctttttgaggatggcgttgacatcttcaatgattttgatgtagttctgctggataatctcttccaggatttccagttccatctcttctttgccgttgcccagtttgaccggtaaggagaaacggggtatctccttctcttcaaaacggcacatatccatctgcacgctgaagaatggcggcttgcctccggcaatcttgccaatgaagtgtccggctgcttgtccggcaatgtcccttgcctttaagactttttctttttgcaggctctccgtgacactgttattgccaccggcttggtgtgaataagattcttgcgcttctttcttctccccaagcaagttctcgatgtctttggcggtcttctcatttccggtcataccgtaagcctgcgttccgcaggaggctttcaggatgttggcacttttctctccatagtccctgaccgcttggttgaagtcctgaacggcgagaatggtagcgacattgtgcttccgggcggttccgatgaaagtgtcaatgccttgcaacaggatggtcggaaattcatctaccatgaatatgctggtcgctttgccgggattgttcatctgtgacatcaagacgctgccgatgcaggaaatagcaggggaaacggcttccttgatggtgggcgcattgcctacgcataacagcgttgggtgttccttgttggttatatccaaagagaactcttcttcgggaagtggcgacaacacccagaagatgtatttgttgttcaggagtaccaacggagtctgtgcggatgatacggctccggctgtctgctgttgtgcacccagtttccaggcggtcagcatggaggacatgttcaatgcgatttcaggatcttccgacagccagtggaatactaggttgctgtcagaaagggcaagggctatcacatggggcagcgtacagataccaagcttcctttccttgaaacatttataggcgattgaatagacgtagttgatggcattgttggcccaaaagtcggtcttttccttccagcttgcttccagattcttcatcagtgtcatgatgatattgcggatgaatagcgattcgtttccctttgacatgtattgcggagaaagtacgttcaccctgaccgtgcgtgacatatccacaaagttgatataggcgaaacggggtgtttccatccccttgttccggaaatgttcgatgcttccgtatgcgatacgtgagaggatgggtgacttgtccttggtgggatcaccctcccaatcgtacacgaatccggcatagttgcgctcggcgcactggtagatgattcccttgatccagctctctgatttaccgcttcccggaccgccgtcgatatagacattctgctgcggcttatggatgaccagcggcccggaggcggtttcaaagcggaagtagaaagccgattcttcccggcttaacccgaaaatgctatcatcggattgggcatgacgccggatgaaataaggcagagtcttgatgacaagcagcgtgtacgctacgaatagaatgggaaatacaaataggttataccacgctgataaccggctgaatccgacaaccagcatggatgccgtaaccagtgtcatactggtgtaaacccatttcttgttttcgtctttcactttgccaaccggaaagagaaaagcgaggcctccgatcaggataacgtagagaaaccggaataggatatccttctccatcagcctttcccacatggccggattacgtagtggagcgtataatcccgtaacgatagcccactgaaacagtacggctgtcccgatgagcgtggatagcaggatcaggatgaatgacaggtctttcttctctctttccatggccgttgctgttattggggttgtccggatgccgttccgtcaccgctctcttttttctctgcctttcccagtaactcaatgcgtgagacggtcaggctgacggatgggatgtggctaccgtcatccttctggaatacatcggcatacacatcgccgcagacatatacctgtgtcccttttttcagatactcaaagactttactctcgtaattcacgaaacagcatacccatagggtctgttcctcgttgttcacgttcttgtacttggtggatacatggaagttgaatccttttccgttcttgttctgccgggcatccgcaccgacataaccgataatttgtcctgtaaacataatgatggtttttaaaagtttataatccgagctgtggctcattcatatttttcatggctggctccgcttccatggaaggcagcgaaatgccgaaagtgctgtgtagcgtttcaaggttgtcggctgtaggatggtttgccgcaacactttccaataaccgtgatgaaggggtaaaaccttcgtttttcatctgctccaataccggacggttgtcttgcaggacggcctgcgtgaaccgttcctccggtgtgaggtactgttccatccgtgcggtatgttcctgaatcatattgctggcttttcctacatcggcaaggatgttgtagatgaatttgggatcttctttcaaggctcccagccagttttttagatacatggcattttcttcccggatatgggtggatattcccaggctttgcccgacggtagcggaggtgagttcggcaaccagttcctctttggcatattgcttgtctccgaaaatcacgcctttttcccggttcagatgctcaggttctccagtcgagtgcgccatctcatgcagtagtgtggagtagaaattctctccgtccttaaactgccccttcaggggtacgacgatatggttatcttctccccttgcatggtaagcactatttccttccttggaataaatggggcagatccattgctgttcccgtaccatcgcatcaatcagaggcacggtgagcatcccttgctcgtccttgatggccggtatcttgaattgctccttcaatgcttcccatttctccggtttcgtttcctgaagattggtctgctgtacgttgaacacattgtatgtcttcagaaacggcgtgaccttatattcctgctgctcgtttttatccaggttcttatatacgtcgaaaggtattttctttccgttcttgtctcttactgagaaattccagtaaatgactgggaatgacttttctcctttcagtatgttaaggccgttgtctttggcttgcatgaaggtcatatagaccggcaggctgtactgctctttttccgaaagtagaaacaacatgaaggaatttactccgttgtaggttcttccctcgatattttgcggaagtcccccaccctttatcccgaaccaaggcttttgccagttgtcttccacctgctttatcttttcgatcatcagttcggcgaaacgctgtaatgctttatcacttgctgtatccatgatttattggtatagatttctgttctcgtaatcaagcagccattctctggccgtttggttgtttgtctcttgctgcttggcagccatctcttcttgataggcttgtgcaagctcttcctgtgcaagtagaaactctaagtcactgatttctcctgcaatgtttttctgtactaattcatcgtaatccataattcctgattttttaggttataagtcattgaaagcccggttgatggtgctggctatcggacgggccatttccttgctgttgtcgggtttgggtgtgctggccagtttgacatctcccagtgtctttgtgctgccttccatcccgaaaatcttttgtacggctatcagtgtgttggcttgcacacccgtttcacgcatccgggtaaggtcttcttgagtgagccggtacccttctttctgtatctcttggatgacatgaaagttgtcggtctgtgcggcatccaacagacgtgcggcctgcctttcatgttcgccctgttcttccggcttggtgccgaacagctggatgacttcatgggtttgcctttcatccagaccgtgttccttaccgattcctttgataaactcttcactgggtttatatccttcctctttgagcttcccgattttttcaaagtcatgtttgcccaccgcttccttaaactcggcttccatattgcgcccctcttcgtgtttttgctcttttgcagcttctatgttggccgcatgggcttccagtttgggggtcatggccttgatcagctcttgtgccttgccgggagtgatactctgtatgttctgtatcatgactcctttcctgtcatccgtcagttggatgtcggcaatgaagtagccttccggactgtgcagcagcttgttctccagtgcatggccgttggcgagcaggtatttgtcggctttggttaacttgtagccgccatattcgctggtctgcccgatgatgtcgggaatcttgatttcctggttggtgcgcaggatgacggagttcagatcccggtcaacttgcagcaggatgtccttcttatttacggtgatgggtacgatgtcaccggcaagcagctgttctttctctttcttgcccaacttctttcccagcaccttgtccgggataaccaacgcctctttgcggtagaatacggagattccgtcatcgttgaaacggagcttccccggtttgccgtgtatctccatcaaatcagacatgacacccttttccagcttggtgcctttcccgtcgaggatgttcccttgcttgtaggcgtattcatagagcgactgtccggtgtagcataccttcaggcgatggtcgatgacggtaaagccgtccttgtcatgtcccttcaggttctcccaccgcttgatgctgatgccatccttctccagctcggcgacatatttaggatcattggcacgttccttgtcaaaaagggcggatacacgttcttttgattggtcacgaaggctttcatcgtactttgctccggctttttccctgatttcgcttacgctcatgctcagctcttccccgtctttgcggaaccggaaatatccgtcccggtattcggtctgatagcccagtgattcggcgatgccgccgaactgtcccacgttgtcgaacatataggtgtctaatgcttctctcagtttcatggctgtggcttgtataagggttctgcggaaaggatgtattcgttcaacacggccagcttgatgtgccgcccgccgtttcgctcgtaaatctcgatctcgaataccttatcatcgggtatcgtgaatttgtcgaaaccaagtatcagccggttccggctcttgcccttgattttcgtatcaaaatctttctgatagataggttcgatggtcgtttcttgctggatggcgttcttgctcttcttttggtcacgctggaaacatttgacaaactcgatgtcgtagtcgatgtatgatttgtttttcaggtcaaagatgaaaaacatgaagtcctcatgcacatacagattggccattgacaactcaaacttgttctcgatgacccccaggctgtagatgttgcgcttcttggtgcgcagctcttggatgcatctttccatttcctcgctgttcacatccacatgggcggtatatttgcgctggtcatcaaaattgtaggtgaatacggaggtattgccccgtttgatggtgatgtggtaagtgttcatggccttatccaccacaaacaggttggaatatgccacggcatctttggcggttgatactttcaactggttgttgtaggcggccagagtgaaggacacctcgttgccgggcgttccgtaagcgatgtcctccggaaagaagaactcggccagatggaggtcgctgacttctgcctgatagtcatggtgctgccatttcccgttgtcctcgtaaatgttcgggtacgaatccgtgccgccttcgggaaggtagcggatgtgataggtgtaaacgcttccgtcgatgcagactacggtcaggttggtctcttcggtgaatccttccgcttgcgccgagagcctgacgatatggggcgcctcttctacccggctggccatgacaagctcctgttcgccgatggcgatatcagatacttgcacaggaaataccaggtgtttcacacagtcgaaagagataaagatgtctttttggctgatggcttgtttccggggagtgccgttttcctgagcgaagagcggcagactgcacacaaagcagtaaaacagtagataaatatatttcttcatgttgtcgatatgttaaacggttcttgaaaaaaaggcggtgaatacggtaatgccccatagaagaagcagggtaatgccgaaagaaacggtcagcggacggatttctttaaaggctcgtccgttccggcgtgatacgtagatccgatagccgaaaaagaccgctgacagcgcaagcaggtaattgagaatgtctatcataatttgtctatcaatgtttgaaggggatgatttttcttgttcgttttctcttgttccatttgctcatagagcttctgtaactccgcttgcacggcttgcctacgcaacttcgattcctgactctcttcttggatatacatttcgtagttggacttgagatgtaccttcacttgtgagaggctcatgttcaagatttgcttggctacctgggtggtggcgttgactacgctggtcacttcgctggccatcgtgccgatggaagagagcggcatgtcaatgttctgtacaagaccttgttccatacgcttggctgcactggctttcaggttattgggcaggttcaaaccttccatggcatcattgtcgaagacaaccaccgatacgggattgaggttgtctcctaccttcaggttgctgactaccacatcgaggcggttggctcccaaagtggcgataccgtaaaacagcgtgttggccggtatcttcatgccggatagggttacgtcctgaagcaaccgcatccgtaccgtactgcccgtgactacggtctggtcgccgtggatgcaagccctgaagaggttgctgtttcccggtgcggaggtcggttggcggcgtacccgcttgccgttttcggcatggtagatcgggcctttttgcatcaggctgtcggcggatggatggccggaagggttggcagcggctttctccgtttttccctcttggtcataattgacaatccgttcatacatgcgcttgcggtatttgtcggattcttccagttccttgcggatgcgtgagttcttcttggcttcccggataatctcgttgagcgcctgctcgtcctccagtccgtccagttggctttccagctgatgagagaagcgtccgttccggccacctccgtattctgccatgacttcgctgtacggatcgttctgcatacggcggatgcgctccagtgtggcacggtcataccgctcctgctggttttgcagctcgaagtaaaaatcagatcctttgacctgagactctttcaggatgcgtgccttctcctgctcttccagtttgtcctgcttataggcttccatcttgtcgttcaccttgtcggccatttccgactgtggttccaaaaaggcttgcgaggcggcctgtctgtcactccctgacggcacgttcccgtcctcacggatgaagaatacataaaggaagaggatgcccaggattaccgggatggccatcaacagcttgttcttgtctttgataagtttattcggttccatggtcggttggtttagaggtttctgactggttttcattcttgcccggagaagctgcctgcgatgtgttggtgccgttgctttccacgggttcggaatagcggacaatccaatcttctatcttggctccgtgcgcattttcctcgctgcgggacagcatatcatagatggtgaactccgcttcgatattacgtgagatgcttccccgtgcccggtacccggtctgcgtgaagattatctttccggaaacgggtatcgtttgtgtgttaatctctacatccttgatgcgtaccccgtaacggatattcttttgtatgagtgagttcagcatattcacatcgttgtactcgttcaacagctccttccccttgttgcctatgaggttgagcgcaagcgaaatgttcttctcgtagctgctctcgtcaaaggcataccagtgggttacgaaggtctttacatggttcatgtattcgtattgccgcatatcgctggcagacaggctgcttgcctcatagacttctccctgcctgtcgatgacgagagcctggccgtatgctttttctattttgttgataaggaagatgatactgctggcaaaagcgatagtcagaatgatgcagtacccggctgaaagccggatagtcagcttgaccgcatcatctgctcctttgaatttcatcagattcatagttctattttttattgttgtcgtttatgaaacttgccccgatagaggcggcaccgcctacgttggtcagcttgccgcctgccgctgcgcctcccatcagggcgatggtggccgccgtggtgacgattgacacggttttcgaaatgattttcccggcatcgctgtgtcctacgattttggaggatagccagaaacagctgcaataagcaccaatcagggcgagatccattcctaaatattgtatctgctgcgtagctgcgtccaccatgtcggcactttccgtatagatggccttgaaggtctgccatatgatttggttcagaatattgatgacggtgaataccatacaggcggagcagagcgtaccgaaccagatactcaactgtttctgaaagaccggcaacatgcttacggcaaagacaaacgggccgagaatgaccagtagcttgacaatgaccacgccgatacccaagatgactacttgtatgattcctaccaatagggcggaaatgccatgaagcacaagggtggcgaggttggcggggttgagcagctgcacaatcttctccacgctggagcgtacaccggtcatttcgtcctcttccatctttttatccagttcgtgctgcatggcgccggtgctgtcttctccggctgctacctccgactggaggctgtgtttgtcgtattcggcaatcatctctccttgttcgatggctgattgtgccatgaactgggcaaattcctgcgcacgctcggaggtcagcgaggtggcttcgttgattacttccatcgtgcctacgatggtttgggcgatgggggtgtatatgcttaggcagaagaacagtaccaggcaacgggcgatttccatcatgtcgggaaatttgtcctcattcgggcttaacagctggctggctccgtgatagagatagttgtatgctaggttgcagataaagcagatgacaccaacaccgaaggcgatgactgtcatttgcgaaacgagttccatcgtcagaccgtccgtgatctgaagtccccagagaaaattatcttgattcataacgctttaattggtgtgtcgtgtgaaagcggccaaccgtccctggtaataggtcttccggttatgccccttcatggatttgtaaatgaccgtggaacgcacggattcgttaaactcacgcatctcttcggcggctttttccaccgattccttcacctgctcgataaaggacatgcgcccttccgagttcatcgagaagtaactggtcacggtggccaccttgaacagcaggtcggtactcaggctcagattgacggtcacacgctgaaagttgagaaatttcaggcagtggtaattcgatcctacgttcaggtaaaagctgtagtcgctgctcaggcaggctacgtcgtccagcaggtcggcaagctctttcaatgatttgagttccttcaactggtcgatcttttgcaggccgagccgcagttcctgggcatcgatcatttcattgatttgtgtaacccatttcttgacattggcgatccattccgttgagttcagcagggtgtggccgggatcatgcacgacgaactgggcatgaacactgccggttcccatcagccctatcgaggcggcaagtccgagtatgagaatgattcttttcatgacggttatttgttggtgatgaataatagggtgaatatgacacataccagccaggctgtcagatagctcttggcattttcctttttcgtggcgagtgcccataccacgaaaatgagcgcaacgcccaaaagtgcggcggcaatgcttccggcaagattgtatgcgctgccgttgaagtcggttgaccagcctagaagggcggtcagcccttgggtggcgtcatccatactttttcctcctttcctccagatagcggttgatggccgtataggtcgagccgctttcgttgaacaactgcttcagtcgtactactgtcgcctggcgcgaatcgaaggctacggcggcgaagtcggacacctcgttgcggaagatgaaggcatcgttcgacatcttgatgaaaaactctctccagcgttccgtgcgctgcaacgactcgatcatataggcctcttcgtccgtgatggaaagcacggctttcacttccggcaggttctgccggtgttctgaatggtcgaggataatcttggtcgcgcagttgatgatgatggagtccttgatactggacggcatgtttttcaaaaacaggatgttctgtgcggccagcgtgatgcttccctcctttttacggaaggttcggtacaggtaggcgatgaagtctccgaatttctcgtcttgcaggaagtcgagtgcttcgtcgatgattagctctttggcaaacccctggcgtttcttgattttatccacgatcatttgcagggtgatgatggcaacgagtggaaagtactctttcttagaggcatcttccatatcgaaggctatcagccggtcatgcacgatatccacgttctcggtagcgttcagcaggaatgacagctctccgtccgtatagggttccagtaaaagcaacagctcctctatctcgaatttctgtttctcaaactcggtcatccgtttgctgaacacttccttcagataagcccggtaagttatcagcgtcgggaagatacgctcatgcttctctcctattgaagaattgttcacatagtcgtaaaatccgatgacggatttcctgagaatggcgttttcggcaggcagcatgggttcacgtaccttccaaatgtagctgataatggcgacgatggtctttatctggtcatcggcagactcggcatccgtggtgtcgatgtacaggtatttgccgttcttgtcacggtcacacaagaaggggttgaacgcaaatttcttctgctcggtagagtcgaagtatttgccccggttcaaggctatcatcgagcggtaagagccgccgatgtcaatgatcatcacatcccggcccagctcatagctttgcaggatgtaattgttcagccagaaagatttaccggaaccggacgggccgataacgatgcggttcttgttgttcagcgccggataatcccagaggtttatcttggcgggagtaccgaaacggtcatggtagatatgccctttctcgtccgaaaggtacatcccctctttttgcagatagcagatggcctgcttggtcgtgttgacgaagccccggtaattggccctggcattgccgggtatgttgcagaagaacaggttgcacagctcggcgttctccacatagcacgaactttggttcataaagctgaagccttgctgtaccagtgcggttttccgcatgagcgaggtgcggtctgtatcgttcagcacgacattgaaggcggtataggcggtctggtagtcgaactgggtaatctcatcgcagaaggctgcctgctcgcgttgcttctctgccgccggagggtagaagttggtgatgtagttcagcgcgtctttctccgcaccgatggccgttacggtggcatctggatcggttatctctatcacgatgtttacgatgtggttgaacggcaggccaagtcctacggggtacagcatcgagcatttgctccgtatgctgtccggtatctctatgtttcccccgtatgccttcgacttgccggtgtgcggcacggccagttcctgaagatgctcgccttcgttggtcagcgaaaggatggaaacgtgctgctgccctattttcatgcttccgctttcactgacagccatagggttgacgctcttctgcgtggcatcgttttccggtgtctcgtaagagaggttgacgtagtcgtagatggcgttgttcagttccgtatcatccatcttgcgtatctcaaactgctggatggacgacaaaccgttctcaaagttcatcagaaaggcttccatttctgtcagccgttgctgatattccttataaggttgcttgaacgggtagtgcagctttcgcatcagcgaggtgcccgatgcgcttttgcgtatcttaccgtttcggctgccgttcgtgaacgtcacatacaggttggtgtaactgttcagtatctccttgccgttgaaatgacggttgttctccgctatcagggcattggaagagtattctgcatgatggtatcgccccgtatagtagaaattctgctgatggatgaccgtgcctgccggaagcagcttcaaaagagcctccaaccgctcatggatgtattgcgcctcgctttccgacaaggtgaacacttcgggcagaagcagccggtagccgacggtgatgtcaccgttcccgttgatgacggcgttctccgtgatggtctggataggcaagacactttccagatccacggatttgtccttcacctctatctctgtctgccggatatacagcagagcaatcagcaggcacagcgcacagattagcagggatatgagtatgatgattcctatcatggttgctgttttaggatgaatttgaaaatctgccgtttgtccgttatctgccggggggtggcgttcttgatccggaggccggtcaggtagtccgggttaccggccttgtgttcctttttcaaggtttggaacagcagaccggatagaaacagaatggcggaaatgattccgatgatgagtatcgggtgcagctgcttgaatatgctcacgatgatgatgatggccgtcagcagcatgaagatggcgaactgtcccgatgacagaccgaagaacttgatcggcttgttgattttacgcatggttctcatggctcttcgtttttagataatcaggaaggctaccatgatgactaccacggcgatgatccagccgagcaggtattccttggcatggggattgttcgtggcaagcgaatagatgacaaagaccagagcgatgccgagtaccgccgccaaaatgtatttggctacgtccagaatggtgtccgcaccctctttggctttgtctgtcacttcggataggctgttaatcttcaggccgctttgtgcctccgccacttgtgccgttcccaacagcgtgaagaatatgagaaaggtgaagataacctttccatagcggttaatgacttggttcgctttttctcttacattttcgattgctttcattttgttcctattttttaattaaacatgaatcgttttcagtctctcccattgcacatccttatacttgatggatatgggctcttctttcggctgttccggcagtggtttgcctgagtagtagtaggctcttccatgcaggtacatatcggctatctcggcagccaattcctcttcttccagctcaggctgaaataccacgcagatgaccggacaggctctctcctgcccttccttgcgcaccgcctcccttatcggcttctctttctcctttccggaagaaagtgctttcttctttttccgaaagtaaaagtgaagcgtgacacaggcgagtatggcaaccagtatcaaatccactacgttcataagagttgccagataatgagccaagtgaccaatgccgtgatataggtgatgatggcctctttggtgcgctcgtggttgcttatcagctttttaagtaccgctagtccggcacatagaaagcctacccctatcagcatggcgcctatttcacggtataaggagatcaggccggatacatttgtatcggctaacaatatgataataagcatggtgatatgatttgtcggttagtagagcagtatctttattcctacgttccagacagtgttccacttgtcaatggataggggattccaatgttgttgtatgcgggcaagcaatgccgttcggggcaggatgaatacttccagttccgtttccagtttcgggccgatgatgaagttgtattccttatcggggtggcggacgtattctgtaccgatgaatcctcccaggccgatgccccagtaaacggatttcaggttgcaggccagggttctgtaataaccgccgtccacaaaaaagtccttacccttgtcatgtatcgtttcgggaatcgtttcttccgggttcaaggtagagacttgcggtaggttggctgtatattcgtaaggtttctcaaaatagctaaacccggctttccaatagcttgtccggttgatgtatctggaaaaggacaggttgtaatagttgcctgcattgccgaacaggttagtgccgtagttcaattcaagtgccgggatgttctcataatggcgttgcgcaaaagcgcttacggtgcataacagcaggctaaggctgatagcagtcagtctgatgtgttccatgggaattactctttaggttattaatgttatatatttttctatttgtctcatacggtgtttccaatttacgcggattcctgtcggcagaaccgaatcaaggtgcttatcgcgttgttttcgctccaaacatatagattatatacgggaggacaaattttatgaagggcttttaaagggcctttcgtgtttatttaatgtgcattaaaaaatacatgtgccgtaaaccggcaggtgtggaataattctacagaaaaaagccggataggattagttgtgtaaaactgtcctgcccggcttatagggtttggtttatatgcgctttcggatgttgctcaatgcttgtggcgtgatgccgatataacttgctatgtcttttaagggtattgaacgtaacagccatttttcattggccaaaagcgctttgtaacgcgcttcggcatccagtgtgtaaaactcctcttcccttattattttgcggttgatggatcttaccaaatgtattctggccagcttgttgaaattgatggataactcatatagctgatgaagatcttttttgggcaatctccagatcttgcatggctccaatgccttgatattgtagtgggcatggtgttcttcatgtgaaaggaaaaaattgatgaactctttggcttggataaaccgtgctgaaatctctctattctctttgtccggaaaccataaccggacgatgccggattccagataatagaggtagcatacttcctcgcccctggtgacgaggtgttctccctttttgatatggataagctcgaaatgagcatcaagatacgccttttcttcgtctgtcatccgcacgtgaagatgggcgcccattaccatgagcgtctcatctatcagggtggcaattgtttgaaccattgaatttgttttatgtttatataagggtacggaaacgtaccctctaacatggacgtggcgttccaacaacaaaggcacgccccgtaccagtttcatactggtacaagcatgcgcctgttgttgttaattccttaacgatagatgccactcttttgttagacagacggacgtatgtaaaaagcgggctgccaattttctgacaatccgctgcaaagatactattttatggtttttgttccaacttttagggatttaagttgacggcaaggtcttctggacgaatgcctactacctttatatagatatcccggtagatgttctccttaatctccttgtcctcttcagaataaagccatgcggtaaattcatgataatattcgccggttcccaatttaaagaaatccttatattgataatgtctgctcacgggaatgcctttcttgtttaacaagaagcatgatttaagcgcatcgtgatattgcgaggtcagtatcgcctttatcttttcgtcgaaatattccaatgtttcctggtcaaagaaaaactgtacggtgtagggccacttctccccttttcctttgatgtattggtattggaatttggttctctccagctttttgttgataccgtttaagatgctggtcaccttcttcttccggtcatggttgtcctttaccgttacatcaaattccttggcaagttggtcaaccgtaacggtgaaataaggtgcttgtccttggtcaatcttatacttgatcaggtaaatcattttcgccaggttcagataaaacttgcggtagcctttgcggttgggcaggttacggtagtctttcagttccagcagattgtattcggtaagcaaagtattcatcagatctttgctcagatgcacgttgtaattccgcttggtgcgctttttcgtgccgaagttatcctttatctcaaagcggtccagtatttgaatgaacttatattgcgtcttgccgttcatggcgtatgctacactgaggttggatgtccctaaacggtataacgccgcttcaaaggtgttctctatcggatgctctatcttttggccgttctgttcggtgatatataccggacgttggttgctgaacaggaaatcaagctgcttctcggtcagttttcgttgcaacttggttcgttcataccccatgacctcacaaaaatcgttgatggagaaccagcagtcgccgaacagatctttcatttgtgaagatgccacgtaaatgataatgtcagacatgacagtgccgcctgcatcaaatagaacttccaatactttcgtgttggaagactcgctgagagtcctggggactctgctcaactctttttgtgtattactttccttcataggcggacacttgttgtttactgatgcaaagatacgtttttttacggagatagtgaatctaactccctataaatgaagattccaaagcatttttttcgtgctgtttcttgatttagttgtgtaaaagtgtcccgactacggctgtttccgatcccccagttgtgtaaaagtgtcccgaatggccggtttagttgtgcagaagtgtcccggattcctgatttagttgtgtaaaagtgtcccgaatgcagattctagttgtgtaaaagtatcccgactttcctgttcagttgtgcagaagtgtcccgaatagtcggttagttgtgcagaagtgtcccggttacgagaagatgccagtaagtgctaacttgcaataatatagttgattatacggaaaacctcccttattagttgtgtaaaagtgtcccacaaatacttaaatccctaaaaacctaaataaaacgaagaaatgattttgttaccgtattcttactttcggaaaaaattttgaggtggaaacaagtagaggtttgaattctttaacatattgtccaggataataggcaaagggatttttccgcagttgtgtaaaagtgtcccggttcaatgccggccttcactaaaacggtgtgcaaaaataacgcctgcccgacggatgcagtcgaacaggcgtatatatttttccgaaagtagaatcagatgctcatatacttcttcagtatcgcttgaatctccttgttatggctggtcaatatgtcttcaagaatgttgtttgcgatgttgtgcattcctaatccagtggccatagcaatctgcttcagctttctgtgggtttcgctggatatccggattacttcggtgttctttaattttcgctcttccagatattccgagaatttttttccgcagactttgctttcttctgtttttggagaagactgcacggaaggtttggattccggcttttccatttgttccggctgaggttcttggacggtttctttgactggagccgattctttcacctcttcatggatggggtgctcaatcgcaggttgggggatagtgctttccgcaacacttccgatctgctggatttcctgctctttcttactggcgctttgcagcaagagttttctcatggcggctgatgatgtcctttctttgttggttgccatagctttattctcctatatggttacagattaattccaatacctcttcacagaaagcatcacagggatgatggtacgctttactcagcgtacttaaattgcgttgatagtcaacccttgaatccttgatgtagttttgcatcaactcgaaaggcaaggtttttttatttttcaaaatttctttgaactccagcacattcggaagaacacggttcataacaccacgcacggtagtctttttaccaatctttcgacggctttcgataatcccttcatagatgttatagtaaaaggtcaatgtaggtcttaaatcggtctggttcggttcgaagggaatgatgatcacgtcaacgaagtgcagcgtttcaactacaccgttttgtttcaggttacccggaaaatcgacaagtataatgtcgtaattgtcctgaaggaaatccagttggttgatgaactctgaggaagagatattgataacctcatattcttcttcctttttcatgattccgtcctcggcttcgtcctcacgtaattttccgatagtgttctgcatgtcgtcgatatccaccacggcaatggataagcccccctcttcgtttgactgcgaatgaatataacctgcaaacaaagctgtcagcgtagacttccctaccccgcccttgggattctcaaaagctacgactactcctggtaatatttgtcccataatgtacgtttttaagtatgtgcgcaaatatataaataataaattaaataattgcatacttttataattaatttattatacacttttttacttaattgtataagtaattacatatataaatataaatataaatatgtacatacttaatcttataattaagtatgtatgttcatactttgtaataatataattagtaattatgtattttgtaactaatggctttccgttcgcctgttacaatgtgcgtagttactttgtaacaaagtgagcggttaatctggattaagaaatcaagacttttgtctggttttgtttcacagctgagtattattgtatatctttgctaatgcaaggtatgtttttgtgggtacaaaaaaccttgcgacagccgagctgccgaccaatgttcgttacactcacatactctgtatatatgaaagagaatcgagatataagtataaagatccgcttgacggaagccgagaaagaacagcttcttcaacgttcaaaggaagagggaaaatccctttcttcctttatcagagagtctgccttgaaaggcagaagcatatcgaaaaccgatgtgcaaatgatatatgaacttcgtaaaataggagccaatatcaaccagcttgccaaacatatcaatacgcttccgtccgatgaaaatatattgtattcattggatcggattaaccaatacctttcggatgtagaaaccattaaccggaaattgttatgatagccgagatacaaccttctttctcatcccacctgtccatgagccggaaaattgaataccagctttccaaggtcaaggaaggaaacggaaaagtgctttacacctccactggtgacgaactggccgccatgccagcctacatgaaacttatctcccagttgaatgaccgggtgaaactaccttatgcggaatttattctgagcctctatccgggagaaagcctttccgatgaacagtggctttctcttgccggggaatatatcgagaggatggggtacggaaagtcctgttatgccgttgtcctaaataccgacaaggcacacagccatgtgcatgtgctgctgaccacaattgatgaagaaggcaaaagcattccttccggaaataattacagccgttccgaaaagatctcaagggaactggagcagaagtacggtctgttgcctttggaaagggaaggaggcaagagaaccacgttgggagaggcgcaataccgtaactattatttcgatgcggccttgaagaaagccatgcgtagttataattacaaggataaggtatcggctgtcctggaacaatccgatacataccggtctttgaataaacccttgcaagaaataaaattggccaatgaagaatggcgtgtcctattgggggatgaaagctatgacaaccttttcgcattgctggaaaaaggaggttttttcaaccccttgttcaaggatgaactgttacaacagcttgaccgcatctactctttttccgaaagtacatccgatttccgaaggaacctggaacaagaaggattgtatatgcgtctggtcaccaagaaggacaaatcctattatgtctatggcatcaaggattcaggcttttacctgaaggacgtttcacttcctcagaaatatcgttttggtaatattcgttttgatggccggggcatgagcgccgatgaacagaagcattatctctatgaccatgtgtttaaggcattgaacgcttctttaggctatgaggattttaagaaaaggttggcggaagaatcgatccgtgtgacggaacatgtaaacagcaaaggcgcatacgggatttccttttatatggaaaacgtggaaaatgctcatgtctttaaaggtgcggatctttcccgtaagctcacttatcagaatatccagaagcatttcgatggtgtggctgtcggtctctcgccacatatcgatagggtaggggagttccgtgagcgggtggatcgtgaggctttctatatgcagggtgggggagttatggccattccggaacttgacattaccggcagcgggaagaagtcgcaagaggatgatctcataccgtccaaaaagaaacggaaacgcaagagtggtcccgatttctcattatgatgaatactaacttaatatatttgctttatgaattatcagaccgttttacagaattatcatcccactgaacagggggatttcatgttgagatatgagataggtggccggggatatgtcgtttactcaccggagaaggatgcgttgtcttgtattgaattacatggcttttccgagcttactccttggcaattggcttttgttctttccttggatatgcagcagatgaaagaacaggacgagctttctctcttcgtatgttgtaagcgagaaaagctcttgtcttatcttttcgatgtggaggaaagcgaaaccgtcttgaagacaaagcacgtgtccggttggcagggctatctgatgatggatatccataagccggacagggtacggaacgtgttccagttccatccggaaacgaaagaagcccgtttggtctttgataaccgtttatgtgtcgcttcccttcgtgagaaagaaaaaggaaagctcatccatctctgttggagtccttctgtctttgctgccatcgataagggaggagagcgtaccgcaccggcttatctgttggcttctgatgctgccttgttgcatgggtatgccatgaaacagattgcggaatgctttgccggtacaccggttgaagaacgggttatcggtattcatgtaggggataatgtctatgaggccttgtcttttgtgtgctattacgtccgtaacgtgcaggatgaatatttggttattcctgagcggaaagatgggatggtgattcttgaaaccccgaaatggaatccgatacgccaggctaacttcgtggcttcactgaacaagatggcggttgaccaggcgaagaaacgctatccggaaatggaggttccgaatgaacggccattcacgtgcctctcttttgcccggaagtctttcgtctatttcccggatctgaaggtgtatcaggaggtgttcttgaagatgtatttggggttggtgaggttacaggaggtgcatttgctggggtaaggaacaattgcagtgctgcttataaaatagtggcactactattgttagagtacttctatcattcctttggttacggcatcggccagtagtctttttacaatcctgccactgggaggattggttatcccaagcgttatctcaaccctgtttgatagaggatgatagtgcaggtattggaggatttcatcttcaatagtcatgttataattcttttatcgggacaattttgcctgatatttatgcttttgtttattgttctgtcccgatagagattattttggatggacaaagaaacgctatccagaaatggaggttccgaatgaacggccattcatgtgcctttcttttgctggaagtctttcgtctatttcccgagtctgaaggtgtatctggagatgtttttgaagatgtattgggaattggtgaggttacaagaggcgcatttgttggaataaggaaaagggtgcatctaatgcccaatttgaaaggatcacctgctacagataactgtaacagggatattatccttaaaaaagtgagttagatacaccattttaaagtgcttctgttatttctttgtttacggtgttggggaataatctttttattactcagttatagggaaaataggtctgatatttatgtttggattatatactttgaggataagtgaagaaagatatctgaaggtggattcttttatttagagttccttttagaataagatttcgccaaacagaaatatatttagaattgtttctcataaacctcaatgctgcaacattgaagtccaatctgtaagcttgatatcttatacatttattcttatttccaacttttcatatagcacaactgcctttatcagaggcagattctccttgcagaaccatggaaaatcgatacatctgaaatcgacatggctctcctccagcagattgagaaaacggatgtcgtctatcatcccttttaaggaaacgaacaggagaggtatcttttttctttggcaaaaaaatagcgccttctgtagttccgcatatgcgatggcttgttcatccttgctagtggaatcatttctcttgtcaaaaaaagacaactggacttttaatgaattatgttgttggaggtattccgccagctgttgctgtgcttcaggagagctggcatctccatacagtattatatcactatattgcttcatatcgggtatttgttccggttgtacgctccttttttccaaaggcacccctgcatattctttcaatagatgctgcttcgtgatctttcggggtttctcaacggagtagaatgcatatctgaatataaactgagtccctttcttctgtacggattcctgttccaggaaaaaagaattcaggcgtatcttgttttcttgaaggatatgtttgggaatatcttcctgatagatatcggtcatgtattgaaggatggtctttttcattagaaaaatcaatgaaaaggttcattaccagtatttataataagtttttccaacccattaatttttgcgtaatgctgtttctgcggtttagaatctgaaaacgaagctactttcgcaagatcctgtgtccggtatatatacttacttacatatggatagtgatattttatcattttaccggcaaatacattccgaatgttttccacattgagtacaatcttgatcttgttgataataatcaatgctatagattatcatttctttttcaatatggatatcaggttgcctaattgaggttcgataactttcttgtaaaccaacttcattcttttgtcagaggttttaacgaaggattttaccatttatagtcaaattgttcaatgtcttcttctgcaagtagatttccggactgcacctcgatgaacgtcaattcagagatagccctgactgcatgtttaacacctttcttgattgtaatcgtatcgcctctgctgataaccgacctgatatcatcgagtaccagttctccctcgccgtcgataaacgtccagacttcatcgcgatggcggtgtacctgatagctgatactcttaccggatttgattttcagttgcttggtaagtgatttgtaaccgtcggaaaactcggcggtatcgacaactttgtattcaccccagcgacgttcttcgaacattggccgatgttgtaggcagtcagcgtaagttttgatgttctcgcttttatctttgtccgaaattaggattccatcatttgatgctgcgataactagattccgtgtgccaatgcacatgattggcagtccaagttcgttgatgacgtgggtattttcggattcttcatccatgacaacattgcccatggtgtgttccgatagttcatcagtcaacgtattccatgtaccaaggtctttccactctccggcaaaaggtacgacggctaccgactgcgctttttcagcgacttcgtagtcaaaactgattttcggaaattccccatagcgagaacgaatttctgaaaaagtgtcggttttgatgtgtcgggttacaatatctgtcatataccccaaccgaaaagcgaatacgcctccgttccagaaagcaccctctgaaataagtttctcggcagttatcatatctggcttttccgtaaagcgtgatacttgaaatattcctttgttctgtacatcattgactggcactacatatccgtattttgctgacggatatgtggggttaattcccatcaatactagttcggctacattgtttttcactgcatccgctatcctgcgaatcgtttcaaaataacctgtttcggtataagggtcgcaaggcatgacgattataatctcatcggtggaacattttcgtttgtaggccaaatacgagcttgcgagagcgatagccgggaatgtatcgcgacgctccggttccgtaactacaggaatctcttctccaagctggttgatgatgatatcccgttgtgactggcttgttgccacagtaatcgaatcacagatgccggtttctcgtaattgccgtaccacccgctgcaccatcgactctttcgagccatcgggcgcagtcaacagtttgataaattgttttgaccgtgtattattggaaagcggccataggcgtttaccagaaccgccggataacagtatgatttgcatagatgttatttaattcgatttttaatttgccgatagtattcttcaagcatcaatttccaaaatttattgcgttcgtaacgtgatgtaatcattgcccttgcattctttgccattctttttacctcattaggattatccaaaaaatatttcatggctttatacaatgcgtgttcgtcttgtggtggaacaattattccatttttgttttgaacaattatttcattacaaccattgatatctgtaacgatttgtggtaattccaaggccccagcttgcatgacaacattagggaaaccttcacgataggagggaaaaacaaaagcctcacaccccattagatagggacgaacatcttgttgaaagccgacaaactcaatgtgagaatttgtgctaatctcttgttttacccaatcatcaaccggataaaggttttcttccataaagccgattaaacgtaatcctatgttaggataatctttctgtaatcgaataaaagaagctactaattcattgattcctttctcataaaatatacgacctacaaaaccaaacgtgaaatcgaaagttgaaatcttaatatcttgtgtagcatttcgcgaatagaatgccgtatcaattccatttgaaccaccattaccgataacaagcatttttttaggattgccgatccccattgaacaaataatatcacacatcttttgtgaattgggatatacatttgtggcacaagcgtaagttaaccgttccgtaaaacgaagaatttgtttttttatgcccgtagccgtcgtcaatgggaagcctgttaccgtgtgcatacggatcggcacacgtgctatccatgctgctaacatacccaaaagaccagctttgggggtgtgcgagtgaacaatagtcggcttctctttgataaaaagttttaccaattggaaaagagttattaaatcgaaaatcggatttatggctcttgacatttttaccggaatacaacgtgcctgttgcttctgtaattcctcccaaccttctcctttaggggcaacggcaatgacatcgaaatatgcggaaaaataattcaattgaccttgaagttgccggacttgaaaataagctgaatttgttattttgaataatttcttttttttcattgaaaagattttattttttttgcaggaactcccccataaatagagaatgagtcaacacttttattaaccaaactatttgcgcctattatacatcttgtatcaatgtgaactccacataaaatcctcactccacaaccaatccatacatcatcatggataactaccgttttttttaggatttcattatatttaataggtaaattaaaatcagaataagtgtgagtacttgttagtattgaacttgaatgggcaatagacacattatttccgatcatcaatcctccgctacattcaaaataacacatcggatgaatactgatattatctcccagttctagtttctctatgttagatatatatacattttctttaattacaacattatcaccgcatttttttgctagatttttcaccaatatgtatctaatcacaataccaacttttcctccaatacctcttaaacttacaaataaaaaattattaagtttcctaggaagatatgaatctactataacgaataccttaattaatggtttaatccgtttaaataaagttctaccgcttagatccgacatgtctaatatctatataattgttttttttatctttcatatgaaacaaatagccaataggcataaaaataatataactagaaattcctatttgttttattttatttttcattttcaatttagagcaaggagcaaaacgccagtaatttatatgagcttttattttttttaaatatggaatatctagtgatgccatttctgaataaattctcatggcataattaggtgaattcattctgtttttgattgatgaaacagataaaccgtctgataaatactctgcgatgtatattttttcattaaaaaataacataaggtaattttttccaatacggtttagaaccaaactttctgcacaaaatttttctccgggtatatcgtcaaataaataatttctcaggactgatgttttaaaaacaaacgcaacatccccttttatattttttataatccaatagttaatccaagaatcttttaaaattttccatgtaacctctttccctatacgagaaccatctggaaagcatttcataccacaaactccagcaaatttatcattattctttatatattgataatgaaaaactattcgttctatagagtcttttgttaaatagtcatcactatctacaatataaaataattctccttttgcatgtaatacgccattgttgattgctctatgttttccaccattctcttgtttgatgaaacgaattaatatacgatcttcattttgataagattttataatttcatcaatatcatcagtgctcccatcgtcaacaataatccattcaaaatttttataggtttgagacaacaaactctgatatagatttccaattaaattcttcctattatataccggtgtaaatacagtaactaaatctttcataaaaatctttttctattgttttgtattttattttatccacattacataagtgaacatataataacatagaataatccattttattcgttctccctggttatttattaagttatcttttagcaagggatatatcaatactataggataaagaaaccaagatagataagcaaatctgttattatacggtacatgaatggtcaatagccagaacgcattacttgctatataagtattaaataaacggataaacaatttgtcttcgtagcaatatgtatagatatatttcactcctgcgataatgggtatcaaactataaataatgaagtcccagcgaaatccaatattagagaacatttgctccatgcctttataagacatattcaaatattcagacatccttttatcctgttcaaaccaaggaatgtttgtcaacaaagtggagaaagaatcacgtgcaacaagcataagcaggaaaaacgttccccataagtataagtagtgtttgggattatttgaaagtcgggtcagcaagaaacagccaattggcaacatgacggattgatggaaaagacatgctataatccaaacaggaattcgtttaatatcgttgtttggaacaagaaaagagaagataactaacgatgtagctattccgttacgcagtccatttactccgtatccccaaaaactcaaagaacaaacgaacaacactagtgctacagcatattgttgtttgaatcgtttctttaaagcaaagaaaacaggcaatatatataatgagcaaagaacaaaccaatacccttttaaattgacgagttgtgaaagccaataggtaagatactcaaaaccaatatctctatctcttatagcaaccgtaccatagaaggctttcttttggaaagccatggcataagctgaagtatctccaaagtagtgataatcggtcggtcggaaagttacatgaacatatacaatcaagagtaaagcaaggctaaatatctggttgttgatataaggctgtcttactgtttctgccctgaccggttgaatagcgatgtaaacaactaatagcagcaacaagttgtaatataaggctatatatagactaatactcataaaatgacatcacaaatttggtccacataatgttcccacgtaattttagcttctatgcgccgacgtgcattacgaccttcatttatagcaagagatttatcgtcgattaacttaatgagtaaattctccaattcttcgtgggcgtcctgatgtatcaaccaaccgccattattctcctcgacagcatcgggaatgccacctgtacgagtacctataacggcggttccacaagcttgcgcttcggcaaaaacaagcccgtatccttctacattcctattatccgcttcttcacgtgtacagagaatgaatatatgcgaggctgaatagaaatcgcaaagtttattatcatcaatgaaaccttcaaatgatacaatatctgacaatcctaaatcggtaaccatccgctcaagtgcactcttatattttcctttacctccgagatgcaatcgcacttgttgcttatactttgccggtaaagaagctatcgtccggataataaaatcatgtcctttaaatttttccaatcgagaaatagaacagaggtgtagcaagccatccttatatttttcacaagtagggcgaaaatgaattgcatcaaccgctaacggaatagcgattgttttagcatttggagaacaatgttttactaatgtctctgtataatgactgttagcaatcacgcaagaggcgtttcttagtataaaacgtcgataagtaggccaaatacagcgtcggaaaaaactctttccggcaagatattcggctccatgtgccaatatataggtttctctgtttgacaatagagacagcattccctctggatgataattcccggtaattacaatatcaccgggaacagtttttttgcgtaaatacttcaatgtacgcaactccaatattcctcttcttccatgcaatctcaccacattattatcctcctctgcatcggtagaagtactttggggacaaatgactgtaacattcagtccttttttctctaaatattttttcagttcaaaacaaagccttgcaataccaccattacttggtggataatcataggttacaataaaaatgtgtttgttagatgtttgcataatgagtatatttaggagttagttttccttttttataaccttctttataagtttttgcaaaaagtctaaacagtccgggattgcggtaagtaaaagcgtatgatgcaacaagacgcaacaaatagatgtaagcagtcggcctatgataccatttgagatgacggctaatcaataaagcccggttatgtactaatgaagcaatatagcgattgatatccagaaccctgcaaccgcctgtatcagcagccaagtgccatacatgagcatcataattaaaaaaaactttgtatccaagttcctttactcgtaaacatatttcggtttcttcatatagagcagctccataattcaaatattcatcaacaccaccaacttctaaaaatatgtctttttttatgctataatttccacctccgccatgatctacatattctttatgattaatgtggaatccccgttctggagttgccgtatagaaatggaacttgcctacatttttcgatttgggattattcttatatttttctgtaattccccctgccactactgcgatatcaggttgtgacaagaacttgtaatgctctttgagcaggttgcagtcacactcgatatcatcatctagaaataggatgtaggcgtattgtgtgtgttgcacaccgaaattacgagcttcaggtagccctctaaattcagtcacatgatagtacttaatcaatgtatcactatcttttgcacgactatacatagtactgtcaatggctgccgattggtctacaataattatttcatacggctccccaaaatcttgctctattaagcaatcaactgtacttgccagataatcagcccgattaagtgtgggcaaaataatgcttatccctttttgcataaggcgtttatgaataatatgaatcaagagttaagaaattaatcacttcgtttaggaattatactctatcagaaatttcactataatgaagcatttctatattttacgtagttgtactgaaatgtttgactttcttcaagatggcaatacaaaaaaagccttaactccccttcgtatgaatatgtgattttataaataaaaagtccgtttaaattttctaataaagcagttgagttaggattcttctacatgatgtttggagctatctcttataactcgattgtaaaattcgatgttttgtgccactatctcgttggtgttgaatctagcagttgcatttagataagccctgtcggcttgttcacacctataaatgggattcgagattagccgttgcaaagcctctgcaaattcatcgatacgtttcaccctgcatttgcaaacacagttactgtctcctataatctcttgaaaacaatcgatatcggaacaaacaattgccttccgcagtaacattgcctccagtaagaccaaaccgaaagtttctgcatggcttggaaatatgcaaatatcggcactgttagcgtatgacatagtcttgtcataaggtaagcgacctaaatacgatacacaaccgatcgattgctttgaaaagagagatttgcatttttcccatgtcgaagaaccattcactactgcatcctgtccgatgagaatgagtttgacattgtcgttttgctcgcatatcctgttgaaaataagaggcaaatcaagtaccccctttttctcaacaattgtcccccaataaagtatcgttattgtatttttgttcatgtcactagatgaaagagggggcatgtttatatccacaggattatatattacacattttctcttattcgaagacagactgaataatttatccgtcaggtcgagagcctgtcggctaactcctatataggcatcagaattacgcaaagcattatattccataagccgtacgttccatggagttttgtttccagacaaatgatcgaaatacacatttgaaccatgtaatcttgtaactactggtacagataaactacaaaaagccaaaggtccctcccagtcgatagattcaacgaggtcgatgccaatctttgccactaatagatttaactttttatttagataccttctattgataaaagaagaaaatggagacttatgaggctggtttataggtatcacagatataccatcgtcccacacagtttctgtaaacttattgccccaatacacaactgataccttcacaccagtctcactcttaacgataagatgagacaaatgtttgataaaaattccgattccgccacatttcatacccaatatcggatattctgtagttaaaaacgctatatgcatctctattgtattttttggaaaatatcaatgaaagattttgtttgttgcgatgccaagtaacggcggcaatattctttgtttgccgtcattggaaatttttcgctaaatacttgtttgatgacagtaacaccttgctgaggagtatctataaaaatacctatgcctgcttttatcaattcggttcgtgcttcgctagtcatgggcaccattgctaatacaggcacttgtaatgcgatataatcgaccatttttgcgaaattagtccaccataaagccgtgtgtccgggaataagtactgctgcttttgcattaactatcaattcatacaatttacgctgcggtacatgattgatatattccacgttgttacagattcccaaatcattgacaaattcttccgtttgtttttgattgatattcttattacccacaattttaagggtgcaacccttgccttttaattccttagaattgacagcttcggcaaatattttcaagaaattatctttatattcatggaggtattcacccacgaatattatataattctctttttctctattttgaaaagaaggcaaataatcatcatctactccagttggaataaaatatgatttatttgagtatcgtccctcatataaatcattaaatatattcaggtatgctcccgacagaccagtaatagcatcagcgtatttaaaagtatcttgttcaattttcttttgcttggcaaaaacaggaaaataatcagaatacattcgcttagcgtatgtggtaggatccctgaaatcagcaacccattttactccggttagatgtttaagtcgcataccgattctatttgaggtaaaaggcaggcaagtggtatatatgatagatatatcatgttctttaattatttttcgtcccatcctcacggcacttctttcccagaatctaaagcggtcgggaacttgaatccatcggtctagtatatatttataaaacttaccgaataaagattgcttgttagaggtgactgtatccgtgctttttgactgtgcaccaatagtttttgctttggctgtaatggctttgagtgaagtatcttctcctccaagcaacattctaaggccgcgcaatgtcggttctatataattggcttgataaataggcacgtcttggacttcgtccaacaaatcaggatcttctaaatatagataattacgattaaccgtcagtactatcggattccaacctgtacgtttaagatattttacaagtttaaatgccctaaataccgcagcatgagtctgtggcggaaaaaaaggagtaattataagtatgtttttattcatcgttttaatttgtttaaaatcaatgcttttacttttttcttattttctttgtctaatagcacataataggacagaacaaccaatattattgaagaactaagagccacgataatcactcttgtaaaggactcaaccaagatatgttgtatgagtaggattgcggtaaaagaaggaatacttatgaaaagattcactaccatcgttgtgaagaaaaaacgtatcggtttgaaatcttcaacataatgatggagtgtatatgagcaaacgatataaatcaataatgtgctcactataggcaatccaaaagcccaagtcaagccgatacctttactaaacaataaccaaagtatcggaatgactgataatgatactgtccccgccataaatgaataaaatttcaaacgtccgacagcttgtattccaatatatataatattattattcaatgatatgaagcttgagactatcaataaaatacagaattcaattgtatatggaggaacttccacgagccataaattcattacataatgtatttcagagataaaaggaatagcaaccaacagatataacacatttgccaaacaagtagtttgctttagtaattgtatcatggcattgaaatcggtcaatgcgtattgctttataatttgcggcctcgaagccattaccaaattggttgatacttgttcaatcatcagttgcacagttgttgccaatccggctgcggcattaacagctgtactgccaaatatattaagcaacatatttgttccctgttgacgagtagtaaagcaaatattggaataaagattccatcctgaaaagctaaacagagaacggccgataaccttattccattcccaattaatccggcattcgtcataatgcctaatgcaataaatgcgatatgtcattgcaatcaagaatgaagataagagcataagtcctccatataaaatgagcttatcacatactgtaataagtagaagtgtagcgatcagcaacttcaacagtgatccaacaatttccacaatagcatacacgtccattttttcgtgcgaaataagagtcgcattgtatggaacttgagtgatgctgaccattgaggaaattattgaaaattgatacacccaaacagctgcactcattctctcatctggaatgttcaatttttcgaataacagccaaagtccgaccgtttcagccaaaaacaagactataattgcaattcctatatgtaatataaaggctgtattgaatgtttgttggagttgtcgagggtcatttttggcaagttcgactgtaagaaagcgtgaagtcgctccactcatcgttacattcaaaaagctaaataggacaacaataccgccgacaagtccataaatgccataatcatctacaccaagtgcatttaacacgatccgtgatgtatatagtgatacaatcatggacagcaacatacgtgcataaagtgccactgtattcttgaatatttttttattatttacggacgatgtcttattcatagcaagcttatgatcttcctaatacagacggaatgtatctttttattaaggttgtcgcaaaatagcatattgcaacaatgagtgcaaattccaatatggtccaactgtagtttacaagatgtaacttattgcgcacgatccagaatgtatctacaaataatatatgtagccccaataatgccaaactgttaattccacaccaaatcaatattttatccaatggaataagtttcagctttctcgaattaaaatatgaattgataaaccaataaaaattcataataaaaaccattgaaagcaacaatagatgcaatggaaaattgtttgattttaagtcaacgtaagagggaaatagaacgatgaaaacaatggcgataataagcaagaataatgagtatatcggtgaaaccttcatgccgtaccatttgttccgcatgaagcaaaaaccaagatggtaataaatcaaggtagacattgttgtgtcaataaaatatggcaaatcaatgttattagcatttaaccaatatcctactccatataataatatacataatgcgctgattgttaatgctttattgtaggggtgattttatgtatcaataaataaacgaatgaaacctcgaacaaacaaattaaaaaccaaattacatgaaataaaataaaagagttttcatcaccgagaaaaccatcaaacatactcgttacagggagcgagatcgcttttgcccaattatgagtttcgttaagtttcaaaacgaacaaatatgcgaacaacaaaaaggcaaaaaaggcccaaggaatcagtaattgtctggtcttttttgcaaaaaactctctcaaactgattggacgaaagaaacagcctgacacaaaaaagaaaaggggcatgtgaaaactgtaaataacggttttcaacatgtaagggatttgtatatgaccaaggatgaccaataaaattcctccccctttcaatatgtcaaaggagacaatccgattagagtctaccatctacaacgtttttttcaaagatagctttaacatcgaatatgacgtgttgagcatttagtaacgtttttacatcaaagcctataaactgttcgtgtgctacagctataattgccgcatcgaatttcttatccaaaggatgttggttcgttaccgagattccatattctcgcataactatatcaggattggcccaaggatcatatacggtgatatgtacgttatactctcgcaaagcattgtaaatatctataacctttgtgttccgcacatcaggacagttttctttaaaagtaaaccctaatatgaggatatgagagttgagcacctgtattcctttcttcagcatcaatttcgcaacttggttggccacatattcccccataccgtcgttcattcggcgaccggctaagattatctcaggattataaccgtgacgttgtgcacattgagccaaataatacggatcaactccaatgcaatggcctccaaccagcccaggcttaaatggcaggaaattccatttggtagaagctgcttccagtacatcctgtgtatcaatgcccattttagtaaatatcttggatagctcattcacaaatgcgatattgatatcacgctgtgagttttctattactttggctgcttccgctactttcatcgtaggagcgagatgtgtaccggcggtaattacagaagcatatacctcatttactttcttacctatttcaggcgtagaaccggaagtaacctttttgattttttctactgtatgaagtttatctcccggatttatacgttcagggctatagccagcaaagaaatcttcattaaatttcaatccggacactttttccacaaccgggatacattcgtcttctgtaacacctggataaacagtagattcatacaccacaatatcccctttggagattaccttaccaacagttgtgctggcaccgtaaagcggagtcaaatccggattgttgtttttgtctaccggagtgggaacggcaactacataaaaattgtaatcacggatttcctctatattggcagtacacttaaaaccattggcaagggcagattggagtagttcatctgacacttcgagtgtcgcatcatgacctgccatcaaagcagtcacacgagcttggttcatgtcaaaacctatcgttttatactttgtcgagaaaagacgagccaaagggagccctacgtaaccaagaccaattacgcaaattttagtttcattcataatttcatctgttattattactttaaatattcttccaataccatttgacagcctctttcaaaccgtcacgcatactgtattgaggattgtaacctaaaagggattttgctttatcaatacatgccaaggaatggggaatatcccccaagcggttgggaccatgaattattttcacgttggcaatttcggggtcaaattcactcaaaaattctttcaagtaaccgaccaactggtttaatgtggtgcgttctccgaaagcagtattgtatacttggttggttgcattcggatttgtcgtggtcatagccagcatgttcatttgaatcacattgtctatataagtaaaatcgcggctatattcaccatctccgttaatgacaggactctcatgagccatgaatttcttaacgaacaaaggaatcaccgcagcatatgccccgaatggatcttgacgacgaccgaaaacattgaaatatcgtaagccgatacattccattccataggttttggcaaacacatcggcgtaaagctcgtttacatactttgttatggcataaggcgaaagcggtttaccaatcacatcttctactttgggaagagactgactgtctccatatgtagaagaacttgctgcatatataaaacgctttacattggcatcgcgagcggctgtcagcatatttaagaatcccgatatattagtttcatttgtagttataggatctttgatagaacgtggaactgagcctaatgctccttcatgcataacgtaatctacattttctacagctttcttacaatcgttcagattccgtatatctcctacgataagtttaaacttattcggatatcgttgtagaaatggaaaaatgttttcaggtttacctgtggaaaaattatccaaacagattacatcatagtcgtgagccaataaatactcacataaattggagccgatgaatcccgctccaccagtaactaaaacttttgttaatgacatatggattgttgttttatgttgaagttgcaagcctattgcttgataggggtgtaatgatttattttaagactggtttggataaaagagagattgtgtgtatctgctccaagtcgattgttacaatttccattgaattccagcctgttggatttttttgtatgtattttatgcaaatccacctagagagaaaaagttaaacagaatctacaggtcttaataaccgataattataatctatttaaactataacagtctgactatcaattaaacagttttgtatattttttgtaatactcgtacaaatgaacttttgaaatatattgtaattgtgaatgtccgttcctatatgagtaatagccttttcttttaatagcagcatggcttttttcttaatccggttgccatacatacccgctattgacggaagattgaactgaaacttcactcccatgtcttttaattgttgataatccgactcacccatataaacataccgttccggatgggcaagaatgggataatagcctttagccttgatgcggagcagaatgttgttcaatcccatcggagggttaaagtaggaggtttccaccagtagatggtcaccgctttcacccaagggcagcagatcgttcttttccaaccgttcctcgaagaggttgtcaagcatgttctctgaggccagatgcagttttatcggaccgctataggtggcttgaagttcagcgtaacgctcccggaggtgcagtgtggtgttgggcatatcttccatgatatgcggtgtaagccatacggattttatgcccaactcttcatacaggcgcagtatttccaatgcttcttccatcgtctgcacaccgtcgtccacacccggcagaatgtgcgagtgacagtcggtaaaattcttgaatataccgctatctttcagcgatatacgtttcctgaatggccacacaatgatacgagtatttttatataaaacattttattttttttaattaataatcatccatttatccccaccctgttttccgtcggaaccttagtggtatcctgagccgtaaccgtagtgataaccatatcgatagccataacggtatccatagcgaccgccacttccctcggtcccgttcaagatcagggacatgttcttgtattttttctcctcgtagattttctccaattcagcaagcatactccgttcaagtaatcctgcacgaactacgaaaacggtacggtcggccagtttctcaataatttgcgtgtcggccaccagttcaacgggcggacagtcgatcagcacatagtcatattgctcccttacagtatcgattgtctgctttaaccgctcgtcgaacaataattccgttgggttaggaggaatcgttcccacgggtagtatatccatagatttatgtttcggatcgggtacgatgatctcatccagattatcgatacgacctcccagatagtcgctcaatcccttgtcaggagagtcgatataggatgatgcagaggcgtggcgcaggtctccgtcgattaccagcactttttttcctttgatggcaaggctcacggcgatgttcatggtcagaaacgatttgccgctgcccggattgaatgaggtcatgatgatgacattcgaagtcttgtccttgccggtcataaattccaggttggtacgcaatacgcggaatgcctcgttgatgatgtcacggttgccctccttgacgataacggccttgacttcctgcggtttctttcctaatatcccttttttctttcttgtgaacagcggaatttcaccgatgaacggtatagtcaggttttccaggtctttccttccccgtacacgggtattcatattctcgcgcatgaagataatgactatcggaatgagcagccccagagcgaatgcgaccataaagatatttttatgcacaggggatgtcggcaacatgctgccgtgtggcggggtaacaatgcgggtattataagccgtgaacgcctgtgagagttcgttctcttcacgcttttgcaacaggaataggtaaagagcttcctttaccttctgttggcgctccaccgaaagcaggtacttggcctgtgttgggttggccgctatacgtgatgtcgtctgttgctccgtctgccgcaaactttttatctgcgaattcaaggtcactatctgattgtcgatagatctgattatcgccccacgcatggatgccagagcctgatccatatccacgaccagcggattttccgtgctgctgttcgcaaccagactgttgcgctgcaacagttgcttgttgtattcggcaatctgcgattcaatattggcgctttcaatgccggagttggccggaagcagttgggtacggttggcatcgttggctaaatagttccggatgtaacgggtcatataaagctggttgttcagggacaggatctgcgcgttggccgcactgctttgagccatatacatactcgatgccgcctgcacgtcgggcaacagatgttctgacttgtaagaggagatatcctcgtccacatttcccagttcccgttcgattacgcccagacgctcgttgatgaacattgaggtgctgacagcgatctggtttttgtccttcacccaattctcgttataaacggaaatcaacatgctcaatacatcttctgcccgctgtgtggagttatccttgaatgacaagtctatgactgacgctttctcgctgttcaatgaaacggacagattggacgagcaggagttgacggcgttatacagactggatttgcctacatataatgtatatgcctcgcctttcacgtaattgggtgttgtatggataatgatttttcccaatggcgtagtgatggagtcgagcaagcttccctttacgtccttttcttcaagatctgtcccgttacgtataaagtcggataggtataacgtaccgtccggctgtatttccaacgtaaaaccggctgattcattctcaggcaagtcatttatcgttacatccaccggtaatgtcagtccataggctacctgacggtggaattttccccgaacgaagtaattcatatccagacgcaaccgtttaaccacttcggtcattaaagacggtgatcgaaaggtgatgagttcgttattcacatttgtaccggattgaaacagcccgaactccgagaaggattccaaatccgaggagaccgacttgcctttggaatcctctttgatcaataccgaagcggtacgtgtatatacggcaggagtgcgtaacagataggcagtagcggcaccgatcgttaccgctaaagacaagacgaaccacttccatcttgcgaggcacaggtataacaggtcctgtattcgcaggaaatcatcctgctgccccggttttatattcttttgatttacggtcatcatatctgattctatattattttacaatcaacacggtaatggtcgtcagcaacgaggccaatgacatccagaaagaggctgagcggacgttattgccgttgacggtcgcctgccgtgctttcattgagttgggttccacataaacgatatcgttctgctgcaaataatacacaggagaggcataaaggtcatatcccgaattcaggttgacctgatacagggtttttttcccgttttcctcccgttgtaccagcacgttttcccgtttcccatagacggtaaggtccccggccatgcttaaggcctccaaaagtgtcagcttgtccttttcgatattgaaacgtccgggggtggcaacctcgcccaacactgaaacggtcaggttcataaactccactgtaacaacggggtctttcacgagattctttgaaaccaattcctcttttatatacgaggcgatctccgcgcgtgtcattcctgccacatggatatgtcccagcacaggaaaatcaatatccccatccttatttattgtatatcctgatattccctgactattggatgtacctgatgtcgtaccaatctgtcgggatatgatcggaaggttgaaaaggttcattaataaggggtctttgctgttgacctgtatggaaatcttgtcttctggacgtatccggatttccagcgggttcaagacttgctctgcggtaccccgtttcaggtccgtgaaataagcgactttcggtgtggcacatgatcccaatagaaaggccacggttaataaggataaaatgtatctgattttcatatttattgatttttatttgttggttttctgttccgattgaagttgtgcgatagattttgtcagcctgatgttggcgagagtccatatcaatatatcacccaaaacgatccagttcacattgagataaagggacagaagaatattgagcagtatgaatatagttgacacggaaacaatgatgatcatggtattgcgctgctttattccgagagcaagcagcttatggtggatatggttcttgtccggcaggaacgggttctttccgttgcgtacccgatgcaggtaaaccctgaccacgtcacagcatggaaccagcaagggtgagaaggccagcaccatcggatgtacatttcctgtattatcgtctagtccgcacatggtcagtttgagactgaggaaacagagcatcatgccgatggtcaaactgcctgtgtcgcccatgaagatcttccttccgtgtttggcgttcccgaaaacattgtaatagaagaatggtaccaacactcccaatgtggcaaacgccagcatggcataaacatactgatggagcataaagaaagtcagtccataaaataggcaggcgatactgcatagcccggaagccagcccgtcaatgccgtcaatcaggttgatggcattgatgatgaagaccacgatcaggatggtcaggggatatcctaaccataacggcaccgcatggatgcccagaacaccgtataggttgttgatatataccccaccggcaataagcatcacgccgcacagaatctggatgacaaacttggcacgataacggataccgatcaggtcatcggccatgccaaccagatatagtaccatgatggagcagaaagcaaaagccaaagagcacacgtcgttcccgatttcggacaatatctccgaatgtcccagcaccatattgattcctagcaacagggctatggtgaaaaacactaccggcttgaatgcgataccacccaatcggggcaccgcacaatgatgtaccttccgctcatcgggaaagtcgaacaatttcttacggaaagcgattagcagaatctggggaatgacgatacccgcacagagaacacaaagcaaaaatgccagtgaacaatttacaatccaaaaatacatatattcaaatattattttatttgtgtaaggccacgaggaaggggaacttcatcatctcctttttgtgtcatctctcaaaatttgtcacaatcggaatcattgatgacttcaatcaaatcgggatgaacttctaccgatatacccataatcccttcaagcatcacaaccacccggcggcgacgttttcctttcacccgcatgaatacgccctttactccattgaacttgccaccgtaaatacatatgtgggtacctttccgtatgtcaatctcttccggtttataataaatagtgttttcttcatactgcgaggcaatcttgataaagctctccatttgcttatccggcaccacgatatatttcagtcccgtgcttttctcccacatcatgaattgtaagaaattatatttttttttgaaatccgtgatctgttttcgggaagcatgcacgaagacgagattcgggatgactggtacaagccttttggatttcactccgtgatagacccttacggcatagtgtttcggtatgaaatactctagaccatccttgcctttgagcatctcttccgcctttttctcgtttttataagcgctcatggcgaaccattggattctagttagatcttcccttgtggttatgggagtactcattcgtcgtgtgttttttagttattacggcaggtcaagatatacccatagttcatcccaacttatgtattggtctgtattatagtaatttatgtcttttttggctgtcatatcaaccattcatgccgtcttttatcttgccgcattcctatttttctccataagagaaatagaggacataaatatttaacatatataattgatttacagggattattcgctgtaaatacaatctagtttactcaacatttgttatgtaaccacgacatttaacgaggtggctattaaggtttttctttgttttatgctattatgttcaataatttatgtatttttgcatattcaaaacatttctcttatggagaaaaccgtcatttattcaatctttttcaagcaagaattttgtactttcacggggctttttcctttctgaatccatcttgtcatacaactgaaagtatagggtatatacttgttcattatattcctatggcattcgtataggaaatttctcctattttcggtgtttctctttctgagagaaatggggtgattggtattttgatgtatatcaaatatttataagattggtataatcaatttgctcaacaaataatcagttttttctaatcatacctcttattttttatggtatgactaatatttttcttctgatttttagtgttttttgtgttatcttttgtacttttgcatttacaaatctttctctcagaaagaaaacttcaatttgtataacataattccaacttattttttgtcagataaataaaaataataattgccatagaataacagcgggccgattgggcacgtatgctgaaacctatggcgtaaactgttttataatgtgaattaaagtgtatttaaaataatactgttcgctttatccactacggaggtgtctaacgatgcaagataaatccgtgtagtgctttctgaatcatgtcccatagcttcgctgatggtagccaacggaatgtttttgcttctggcgatagaagcccaggcgtgacgtgccacataactcgtcagcggaataggaaggccgatttgttttcccaatttctttagttttgaattcaccagctgggctgcattcttgtattgtttccgttcatccgtttttgcgtcgagaatgatcggcaatagataagaagaacctatggtatcgtatttatctatgatttcttgcatgggcttttcccatttgattactagctgttggttggtcttttttctgcgatatgataaaaaaccgttttgcaaattacttttctttagataagccatgtctataaatgacatccctcgggtataaaaactgaacataaataggtctcttgcatattccaaagaggagtcgtgacttaaatccatatcgcgtatctgtcggataattttggccggaactgcccgttttacagttttatctatgcccgtatatacatgtttaaacggatatcgctgtataaccaattctttttctacggcacgattatacatggctctgaggtttctcatgtaataggaagtactgttcggacaaatgtcattagattttagatattgttcatattccatcatcaggttggagtctatattgtcgaaagggatgtctctgcctttctttctgaaattcatgaatcgcttgaagctattgagcgtagtggtataagtttctgtggtgcgtattttacctatttgtctcaattcttcaatgagattctcacaaaatgacacaaagtactcgttcacaggaggagcggaataatattcaatgatttcgtctgccgtatatttgtatccaagattctcaaatcttatcataatatcttttagacgtgaggtgtcttcctcaatacatttttttaaagaaaccaaataccgatgccggttttctcctgtctttgctggtatgattatttgggaattgaaaatatcccactcgtcaggataaatcttgtatcctgaatttatctgccttgctacacgattatgaattacttgatagaacaatgttcccgcttttccttctatagaggaatgtcgatactttatttttaatgatgccatttttttgtttaattaatattatattctccaaaataaatgttttggcgtattatatgtttaataaccaataaattagataactgtttgattttgattatagttggatttatattgatatggcgaaatacttggctattatatatcaatgtgaataatgttggattttattcttcttttatttccgtactgcccttttccttgttttctgcctcccctaatgtacgttttttcatagccccgtctgagagcctttgtttttgaacggcaaatttatttcggtggatggatacgaaagagttccggtcttcgccctttgtaccgaaaaaaataacgccggacggcttcgctgtccccaacattttttgtcgtccaaaacttttctcaatccctccttccttcttgttgtgtgccgtaaaaaaaaggcttataaactcagatggggcatgaaagctcaaaaaaaaagtcggcagaaagaaaaggtcatcccggaaaggggttttaaaaaaaggtctttaaatctagctgaagcataaaattagaagtttaaccctttaaaaatgtgacatatgattacagtgacggaacaactaaagaatgtgtttgaagccaaccctttgtactcaaaagaggggcaggggcttaatgcggaagtcatcgcaaggtttttccttcctttttcttcggtggtatggttggtaacggaagccgaacagcaggaagacggtgactggctttttttcggttattgccatattcaagaatgggaatggggttatgtgcttctttctcaaattcaagaggtgaatgttcgtgggttgaccgtgcagctggataaaggactgaaaaccggtataacggtaaaagcttgcctgaattgattagagaataaacggagagggaacaacccctttccgctttccaaccggaatattgaacttaaaaacggaagttatggtttacgagacgaattgcacggaaataacacaggacaaatggcgtgagctgatgaagtacggtagaaaatgctcctatcggctgcttacggcgagaatcaagcgggaattgccggaattataccatgcgctggctctccagttctataatccttatgcggaacagtgcaggcagacacccacacattatatattggttcattcggccattgaatattttatcagaaaacaataaaggacaaatggttatgaaaacaaaaaaggttgataaaaagaaaacgctggcttatgcggtggcattttactttacggatgtttccgtaaagttcatgatggggaatgcgatgtatgagtatgtacataccgtttatgacaggcggtatgataacggtggctttaatacgcttgccgtagtctataattacaagaggatgaagtacgaggtattggtcgtatcggacgagaaggtaggtgataaggagattcatatattataagtttcacaaacagggcttttgccatataaaaacggcttttgagatgaaaaagttatcggcttatacggttgcatccaactgcaccgacttgacggatatacgtgacggcatcgctgaaatacatgaagcgatgaagacttgcgttgaatccgggaaacatatcccttcattctatgtttcccggttggccaaactggaaactaaaaagaagaaactggagaaacggacgcaggtacacatgaccgtcaccatccgtttctttatagatgatgatacccttacaatggcagtcaggcattgccttttcttcaagctggaaccgactcggcagaatgtgatgaaagccatccgtgatgcggttcttaataacggacgttccattcttgactttccggaagcatggggagaagatcttatggatgtgtctttctttgatgtggagaatgccatgaagaagctgcgttcctcattcggcctataaacttcattgcatatttttccgaaagtaaagtaaccgttggatttttggccagcggttcttttttcaaaaaagaaccaaaaactttgaatacaatcttttttcatcttctaacttatgtattcggaaaaaattccatggcattcagaaaagggatgatagcggtttggggattatagggtagatttgtggggtaagcttacagagacagtttttataggcaggttccgaaaagcctttgagagagtaggagaacatgagttataatatatggctataagtataaatgatagacaattgattacacaatttattactaatactcagaatttgaatgttaatttacctacaaatggtggagggtgtgctaatttagttagaggaattatagaacaggcaacaggaaaaagaatttcagttaatccttttggagcttctttagaaagtatgatacaaaaaataaatacctatcatgatttagctaaatgtaataatggagatatattatattttgtgcatcttcctaatgctgctgtaaatttacatcaaactattcattatgcaattttttgtaatgttaataatgctggtgtacagaaaaatgttattgggataaatggattagcagatctttctttttctcccacagcttatcatggtgttgtagcatctgtaatatctccgggtaattttaatggagtagggcaggtgatatatgatactgtagcattccctaatattcttggtgaattgtatgttattgattatgaattgatataggaataagtttcttcgttattttatggcgtacagtagtatagaaatagaaaaaaactgaaaattgaatagtaaatttgtttgctccatgttacgtttattaccgcttgtaatcgggctttgcgcagactttatgtcctgaaggctttttagtaccccttccatttggaagattttgacagcagcgatgaaggtggtggaggatatatccggctggaggcttttcagtgtgttctccgatggctgatatcctctcatcttcagttccagaatggtattgaaaagtcatcatttcgcatagccttcatgaaagcctcctcttgttcgttggcaatgtccggatttggatcgtatgcagttgcttgccgaacaagaacagactttttattaatgtaatagtgtcgctattcgtctgtttttatcttctagctaaaggcagtaacaaccgttccacaagttctttcttgttctcaacgggcatcttgtttctgcctttggcaatgacttcagcagccaaatcgcttttacgcccggcaatgtatttctgtcgctttccgtttatgaaggcctcgatacggaaatcatgccgggtgttttcgatgatgttgatttctgataccaaaaagccatcctctgtctcgtagggttcgacaatggtgggcaggtagtgtttcatggttttccctatgatcggagataccaaaccggaaagatgctcttcgatgcggtctttccaatagtcatcgatttgatgattggtggcataatcgtaaaaatggctgatggcaaggctgacttcttcgattatccttttcgcattctttattccgttctgtttggcaaattgcatcaggtcatcttccgtgatgtcgttatcttttcctgcaatgctcatggagtgtgcgttttcgtatgccgcaccgtccaaattggtggtgaatgtcatgtcgtaggctggggtgatgtgccatgtgccgtttctttccatcaggaaagagaaattcttgatgtggtcatccacattgccgcccatgatattgaataccgtcctacggtagagttcggactgttcgcttgccgggatgttcagttttcggcagacttcaaacaaatcctcatagctcgttgcatccggattcatggcagcaagtgtctgtgtatgtatcttctctccgtttatcctatcgtaacgctccgtcaggaagtgatgttttccctcaatttgaatgagtcgggaaggcatcatcgtaatcccggcttcctttgccatctcataatataccatttccatttgcgtgaacggaaaatcgtccccttctgcaaacttcaatatgtagtaggtatagccctccggtaaagggacttggccggaacgtatatcatgtgtcgtttcattgatggcgatgatggctttcgggtgctgccctccggctgatgtacctatctcatagatactttgcagttgcagtgcttcgtcatcttgcacggatatttcctcccgttcctcaaagatacggcgtgccagttggtataaactctctatctggagagtggaagaggattccaatccaggagtggccgggatgaactcaaaggctcccattccccgtttcccgatgaaagacagtttatctaccggtgtgagtttgcgcttggggatatggttttgtgccgcccattggtcgaagaccatgttaccccaccgatcaggcaatgaatctgccaaaaacggtgggagaccttgataagtcttttctttgtttccgagtatgggcataccctttgccgccggtcctttgacagaagcggtcagtggggcgatttccactcctttcttgatgaaatccggatgatagttgaagacggctcttttgtttctttcgtcccaatagagctttccgacttcttctccccataacataacactcacaacattattttccatgtcttatccttttcggctttttattcattattcgttccattgtataggctgaaacaggtatttccggcatcagatcatccatctgttccagacagtccactactcgtaacagggcaagaaagttgcccatattgatgttataggccttcccgttctcaaactggcgtaaggtgataaggctgacaccggctttctcggcagcctctttttgggtgagcctataggttagcctgtattccttaaatcgtctgcccagttccactatgatttccggattggccatggcttgggtgatgtgattcgttgtcattttacaaaggtaaatatattaattgttaaatcaaaatatgatatataacaattaatatatttactgttatattgaattgtgcgcgatgtagtttgtgtgctaatcccccaattccatgctacgtttattgccgcctgtaatcgggctttgcgcgggttttatgtcctgaaggctttttagcatcccttccatttggaagattttggcggcagcgatgaaggtggtggcggatacatccggctggaggcttttcagtgtgttctccgatggctgatatcctctcatcttcagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggctggaggcttttcagtgtgttctccgatggctgatatcctctcatcttcagtttcagaatggtattgaagtcatcatttcgcatagccttcatgaaagcctgctcttgttcgttggcaatgtccggcatatggatcgtatgcagttgcttgccgaacaagagcaggttttctccgataaaatcggcgtgttccggcttgaccccgcaatccttggcagtctcatgccaatgcgatacggtttcctgtatctcttcgataatctgtttgtgtttccggatacccatgttctcacctaccttttgcagatcttccatcgtgaaattgtcttgtttgccgttgagtgacagctggtggcggttcgtccatttgccgcccggtgtgtatgagtagcagaggtcgtatgctggggccagtttccacttcccttgtctatccatcaggaaagataagttcttgctatggtcgtcatggttccggctcatgacgttgaacaccattcttcggtatagttcctcctgctctggataagggaggttcatctgccgcatgatacggaatatctcttcgtatgaatggcgttggtcacggtcatagtgggcaagcccggccaatgtctgtacatggatcttctctccgtcttccatacggtcaaaacgtcgtgtcataaagtgatatgactctttttcctgaagtaaccggcattccatcatatcgataccgcaggcttttgccatccggtgataggcatattcgatatttcctattccttgtggattgtccgttatctgcgtgtgttcgctgtatttgccgccatcaaatttcaacagccaatacccgaatccttcaggagcttttacctgtccggagcgtacctctccggtaatatcgttgtaggcgatgatggccttgggcttggcacctccggcagatgttcccactttcagtatatccagaatgtttcttccttcctggcgcagttggacctgaaaagccattctgtccgtgaatacggatttggcaagctcagtcagttcctcgatatggagcactgatgattcgttcatgccgttgattggcgaggacggctcaaactccagtgcgcccatgccacgtttgcctacatagcaaagcctgtctaaaggggtaatctcttctccggacaatcccttgctggcaaaccattcattgatgatctggtttccgaaagtgtccggcagtgaatcggcaaacaggccgggcaaccccttgaaacagtcggtacggttttcaaggaaccggtagggggtgttcctgtactggctgatgggcatgatgatgggagaaatgtcaagaccggagcggatgaacttccgttcatagtcgaacaaggcggcattgctttccttttcccaatagagagagcctacgctttctccccatagctttacatctactatcaaatcattcatggttatcttgttttaaatggcgtacacggtagcgtttctttccttgcagttttttgagctctatcgggctgacccggatttccggtaccagttgctccaggttctccagcaggccgagcgagcggagtacgctgatgaacaacagcagcgataccgatttgcccttctcgatgttcgcaacggtcaaggggcttacaccggaagccgttgccagttcttcctgcgtgatatgctgcctgatacgtgtctctttgatgcgctggccgattctcatcagcacagctggattgctcatttcattccacatggttgttccttttttgcaaatatacaaataatccatgtaaatatatagattaacttgaatatatgatgttaatctatatgaatacaatgattatagttgctttatcggctgtttttttctttgaactaggatgaaaactgactaaaatcacaatgtgttgtgaatatgaaagagctaggaaagatgattaaagagtgcaggaagagtttgaaggtcaatcagctggaacttctccgaactggcgggcgtgggcatcaatacgctggtggccatcgagcgtggagaaggcaatcctaaattggctactgctttccattggagttgattaaagtgcggaaaaatgtataagattgcttctattatctgtttattttagtatatttgtgctttaaataagtgcggataaatgtattatacgctgtttttacatgtataaaaatgctgtttgtagatgaaaagatttgttttgcaacaacttatagaatggaaaaaccgtgaggatagaaaacctctgattttaaatggtgcccgacaagttgggaaaacatggctgctccatgagtttgccaaacttgaatacaaaaaagaggcttatgtggtatgccgtaagaataaccttgcacgccagcttttttctcaggatttcaatgttgacagaattttacgggggctgcgtgcgatgacttccgttgacattactccgggtgatacgcttattatccttgatgagatacaagatatcccggaagcactggaatctttgaagtattttaaagaggaggttccggagtatcatatagctgtggcaggttcacttttggggatatcccttcatcaggatgtgtcttatcccgtagggaaggtaaatgtcatcaatatatttcctatgaactttgaagagtttcttgtcgccaagggagaagaagaagcttgtaaattgcttatgagtggggattttgaaacgataagcctcctgcatgacaaatatacggatctccttcggcaatattattatgtaggtggtatgccggaagttgtactcaaatatgtagaaacggattccttgctggaagtcagaagaatacagtcggagattttgcaaggctatgatcttgacttctcaaaacatgcgcccaaagaacaggttccgcgtgtccgaatggtatggaacagcattccttcccaattatttaaagaaaacaagaaattcatttacggagctttgcgaaaaggtgccagagccaatgattttgagatggccattcaatggcttgtaaatgccgggttgttgtataaagtgcctcgatgtaccaaaccggagcttccgcttgatatttatgaagacctgtcggctttcaaactctatatggttgatttggggcttatgggtgctatggtcaagacagatccggcccaagtcttgattaaaaacgacatatttaaggaatacaagggaggaatgactgaacagtatgtattgcagcagatgaaaagtaagggcgtgtcaccgatttattaccataacacagacaattcgcgtcttgagttggattttgttattcaacgtaatgcccaaatggtgccgatagaagtgaaggccgaagggaatgtccgggccaattcgttgacagcattactgggaaaaagaccggaattgcatgcggagagattttctatgttgccttataaagtacagggtaatcttacaaattttccgctatatgcaatataggtgtatccttttcccatgccggtcataccgttagaactgattgataagtatgatgcgtatgttggccggtatgtctatctttgtggcaatgaaaacagagagaggattgatttacgccttgttttccgggacggaaaggagattggcacggatgatctgaatctgtattataattgatgtgacggcttggatgtcccccggatgaatgttcgggggattctttttcttttgggcgttcctgtgggacggtcgggctttacgtttcaagtcctcgcctaaaggctgtgggctttactctgcaatccctaacgcatggctgaaaactcttcttgccggtgttcttcttcttcatacagcctcatgcgttcttgtaatgcttcttttaaattgtcgctttttttcagtccgagtttggcacgtatgttcgctcgttggctggttatgtttccgctactccgatgtaataattcgcatatttggctgacggtcttgtcttgcagtattaaacggcagatgtttaattcggacggggataaattgggatatattctcctgattgtatcaagtttacttttttcctttttctggtatgcggcaagggctgtaaaaagattttctttggattgttcccctattatgtttaacagggagcttgtcttttcttccgggttattctcgcttaacaactcggcgaacgcgaatagttcttcctttttcatttggagacgtttcaaaagcatttcctcttcctcttttagcaagttgctactttttagcaagctgctgatattactgtgtaaggatcttcctaataaggggatcatggtgtatatgatgatgatcaaaggcagataactgtataggaacggttcgtcggtgataagtgtgcagattgtataggaagctatggtaagggaggacaataggatggagatattactcatataggcacagatggaaagcatggtaaataagagagagatagtaatgttactcattatcaatgctctttgataactatattcatatccgctacatattgagcaataaattatttcgataaaaatctcgatatgtatggctatcagtataatggaaaaggtcgtggtcagatttactctctttttaaaataagcgagagtgcacataatgataaacaggaataatacgctgttaatataataaaactgttcattgggaaatggaactgaatatatgtatatgggtgcgcataagaccagcatgagcagggatagatgaaagactcgtttttgttgatacgttattatcatttctctttcttttttgtcgtaagtttgagtttttattgaacttagaaaagaggcggcttttgtgctgattttcatgtgttttattgttttaagtgttattaagtataatgtttcctgcaaaaataactgtttttttttttttttttttttgtatgtttaagtacttttctttatgatgttaagtgtttttaattgttgtgtaagcgtgattggctgctgtggtaagtgttgtagctgttgtgtggttgtctttttaagtatttataagtttaaaatacttgttttttgctttggaggttggtttataagtgcatatctttagcggttgaaattcagggggtgtaaaagcctgggtttggattgtcatattaacaaatgattaaatgacgaaaagatgttttttttatattaaatgtgtattgttcgtgctcgtgttgagtataagcggagaaatatccgctcaggagaagcgtgattcggtaaggatctattttcatcaaggaaaggtaaatatagatacatgtttacttgacaatgggaacgagatggagcggtttgctaaaatctgttccgcattgaacgactccgtccgtcttatcaggaaaattcaaataataggaggagcttccccggaaggaggggggctgttgaatggaaggctgtctgaaaaacgagcagaggttttgtggcggtatatatcaccttatataaagattccggtattggagaaggattttcatttttcgggaagcgactggaacggacttataacgatggtgagagcggatgtgaatgttccggagagggaggatgtccttcgtttgttggagaagatcgtccgtttggaaaaccaggacagcccttatttggggggagaactgaaaagactgaaaggggggaggccatactcatatttgtataaattccattttccgaaacttcgttcgtcgatggtgaaaatatgctatgatagtgatccgataaatcccgtcagagatacggtatatatacatacacgtgatacgttgtgcatccgtgataccgttaccgtcatagctccggtaaagaaacggccgttttgcatggcggtgaaaacaaacttgctttatgacgctgttttgatacctgacatcggggttgagttctgtttggggaagaactggtctgtggccgggaattggatgtatgcctggtggaaaagtgatcggaagcataattattggcgtatctatgggggagatgtggagttgcgccgctggttcggtcggagagcggtggaaaaaccgttttccgggcatcatgtcggattgtacgggcagatcgtcacctatgatttcgaattgggtgggaaaggttacttgggggataaatggagttacgggggaggcgtggcttacggctactcgttacctgtgggacatcggttcaatgtggatttcacgttgggaatcggctaccttggaggatcgtacaaggagtacatccctttggacggtcactatgtatggcagaccactaaaaaccgccgctggttcggcccgaccaaggcgggtatctctttggtgtggttgatcgggcgggggaattatagccggaagaaaggaggcaggcagtgatacggatacgctttagtctggtgttcatatttttatggataggactgacggcttgtgagcataaggatttatgttacgatcatccgcactttgccacggtgcgggtaatattcgactggaccaagatttccaatcatgacaagcctgaaggcatgagggtcgtattttatccgaccgacgatgaaagcaacacgtggatatttgatttccccggaggagaggatggggaagtggagcttcccgagaatgattaccgggtaatttgcttcaactacgataccgacgggatggtttggaaagaaaacggcagttacacgctttttactgccgatacgcgtgatgtgcagtcgccggataaccggacaatggctgtcaccccaccttggctgtgtggcgaccatatagacgaagttatcctcaaggacattccgggaggaagcgcggagatagtacggctgactcccgtaaacatggtatgtcactacacgtatgaggtgaacggtcttcggggactggatagggtggcggatttgcgggccgctctttccggcatgtccggctcgcttaacatgtccgccgacagtttgcccgccggtctttcggagagcctgctctttgatggaatggtttcacggaatcagattataggcggattctatacgtttggacattccgcacttgaaggagagcccaatgttttccggttgtatctcaagaaccgttcaggcagcatgtctgtattggaacaggacgtgagcggccaagtgcatgatgtcccggtagtggggcatgtcggtgatgtgcatctggtgttgaattttgattatgaggttccatccgagccgggaagtgacggtgcgggatttgatgtggacgttgatgattgggatgatgtgaatatggatatagtgttgtaatatgagtttattaattatatgtatcaatttgatttatttttatttatgaaaaaaagtacagtaatgctttgggcaatctttggagctctactcatgggttgctcagacgaggagattgcgaatgtggaaacctcctcacggaatgcgattggttttaacgtgttaagtaatgcggcggaaacgagggctacccctactaccaacaccaacttgaagaacaccgatttcgacgtgttcgcttttacggcggatggtactgccttcatgggaaaggtagacacggattttggacatgacggagtgaatatcgtgtacaataatggtaagtgggattataaaaatgcgagcgaccttcgttattggcctaccgaggctttggacttttacgcattcaatcccggaacggttgatgaagccatgcagtggagttatatgtgggaagccaccaaggatactcaaaagataacttattcctgctccgatgagtatggatctggtatcaatgctcatgaaaactacgacgtgatgtatgccatagccaaaggccagacaaaagacaagaacaacggagtagtgaaatttaacttcaagcatattctgtcacaggtcgtattcaaagcaaagaccgaatacgataacatgcaggtgaatataaaggacatcaagatttttaatgtaaaaatgggcggcgtctacacattgcctgcgacagccgatggaacgggaagttgggctgtgggtgattggcctgaaagctctacaggaggaggttttattaccgtagtgcaaggcaaattcatcgaggtcaatagtaataccacagctaccgatatttccgaaaaaactcctatgctgaatataccacagaagctgacagcatggaaagtttccgaagaagccaccaataccaagataaaagccgacggtgcgcatcaatgttacctgtcgatcacctgcaaaatccagcagtccggaggttatctgttgggttcagcagatagttacggaacaatttatgttccgttcggagatacatgggtagcgggcaagcgtcatatctacacgttgattttcggtggtggttatactgatcagggagaggctgtgttgaatccgatccagtttgatgcagagacaacaggctgggttgatgcaaatagcaacgtaaacgttaaaccttaaacaaaaagtttatcaatatcgtacccgttggcaggttaaacatacgcaagattaatcccgccaacgggttctttatagggaatcgcattttcaatatactttttgatgtgtaggggtgctttttgcgtacctttttcctggagaatttcttttgtggagtgtttgccctgtatattcccgatacgctgttatagcagggaactgtttttatccaagtagtcagatatagcctcttgcaataccgattttagcgaatcgcctttgcggatcgcgatcagctttaagttctggtgataggtttcgtccatgacaaaattacaatgcacggttttcgctttcttcggcttttgagcctctttttgcccggccgtggattggatcaggctgtctaatcccccggtcagcccggccgacatactgttttttaaatcgttcttctttgccatatggttactttatttctgttagcagttcgttacataccttttcgtagtcctctgccccggcagatttgggggcatagtgaaaaatatcctgcccttgtgtcggggcttcggccagcgtaatggcgttgcgtatatgggtgctgaacactttgccctggaatgtttcctgtaccagttccgaaacgctcttgttcaggttctttcttccgtcgtactgggttatcagaaccccggctatcgaaagatccgagttcaaacgttgctgcaccttgtggacgacctgcataagtttggccattccacgcattgccaggaattgagcctgaaccgggataatcaaccgatccgaggccgtcagtgcgttaagcgtgagcagcgacagcgaggggggacagtcgatcaggatataatcgaatttctccttttggcccttgataaggtgggctaagataagctcccgtccggcctcgttgattaactccgtttcaacggccgagagatccaggcaggagggaacgacgctaaggccgtccttatgctcgtagatcggcaggtcgtattcgcctttcatcgcaccgtagatcgtttggggaagctccgcagagaagcccagcgattcggtcaggttggcctgcccgtcaaggtcgatcaaaagaaccttgtaccctttttgacgtaacgcaccgcccaggttgatcgtggttgtggtctttcctactccccccttgtgattcaatacggagattacttttgctttgctcataaattcagttttttaaatggttgtcatgtccgcaacatatagtcaaaatactaatatactaaaagactaaaagtagtattttcgttttttgcgtgttttttgtaccgatcggggaagcgtaccgaaataaatcctgtttccgtctttcggtacgttttgtttctgtaccggaattaatcaaagattagaataaccataaatgtttttatacgttaatcatacgtatgtatatatgtatatatttgttttgagtatctttgtgtgctatgaataaaaaataaaagacatgagcacttattcgtataaaaatccgaagtttataaattcccctaaaggggtggttgaagttgtagaagtgatttatgacggcaaagatgatccggcctattcactggctattattaaatgggaaaatacctataaattaggtattcgttggaacatcgcttatagtgaatgggacgattaccgcaaacagaacgggcaagatgaatgtataggtaatccacagtcgagaggtattcccacctggtttgttttgcccgatgatatgatgtttagtgagaagttcagcggtgcgatgcagaggcttgatgaattaagaaaaggtaaataagtaatggaacagggagaaatcatattataccagccggatgaagcggtcaggttggaagtgaggctggaagatgaaaccgtttggctgacacaggcgcaaattgtggatctttttcaatccagcaaagcaaatataagcgagcatataaaaaacatatatgatcagaaagaattagaggaaagttcaactgttcgggatttccgaacagttcgacaggaaggcaaacggcaagtgatgcgcaatctgacttattacaatttggatgcgatcatatccattgggtttcgtgtcaatagtaaaagaggtattttatttaggcaatgggcgaataaggttttaaaggactatcttttaaaagggtattccattaataaacgtttgtcagaacttgaaaggactgtcgctcaacataccgagaagatagatttttttgtgcgtactgccttgcccccggtcgaaggcattttttataacggccagattttcgatgcgtacaagttcgctaccgatctggtaaagtcggccaggcgttcgatcgtgcttatcgacaactatgtggacgaaacggtcttgctcatgttgagtaaacgcagcgtcggtgtctcggccaccatttacacccagcgtatcacgcagcaactccaacttgatcttgacaggcataacagccagtacccacctatcgacatcaggacgtaccgggacagtcacgaccgtttcctgatcgttgatgaaacggacgtgtaccatatcggagcctcgttaaaggatctggggaaaaagatgttcgctttctcaaagctggatattccggcggctgtgattactgacctgttataatatcctttgtcttatgaatgggctgtcgcaaaagaaaaacccgttcttgatgaacgggtatatccttgacttggttacgtgttttgataacagaggctttaccaagcattacaatgcaaagatagtaattataggttaattagcgaatttcttttttggatagatccggaaataatgcctccttgaaagaggtggataaggtgattaaaacaatagataaggaagaacaaaagcaaaagggatgaatgtggttatttattcacgtgtaagctcgcagtcggccaggcaatcgaccgaacggcaggttgtcgatctggagaggttcgcagccggacgggggtacgaggtgacggcggtctttgaggaaaagataagcggacgaaaggccaatatcgaacgcccggttttaagccgttgcctggaatactgcacagatccgcagaaccgggtggatatgttgttgctgaccgagatctcacgcctggggcgttcaaccctggagatcctaaagtcactcgatacgctgcacacgcataaaatatgcgtgtatattcaaaacctgaacctggaaacgttacggccggacaagacggtaaaccccttgtcctctctgatcactaccctgttgggggaactggccgcgatcgaacgccaggggatcatcgaccgccttaatagcggacgggagttgtacatccagaaagggggcaggctgggacggaagccgggaagccggaaaacggccgaacagaggaaagaggaataccgggaggcgatcgccttgttaaagaaaggctactcgatccggaacgtggcgaagctcacgggaaaggccgtttcgacgatacaacaagtaaaaaaagacttcattagtagctgattatcggaacaaatattgtatttttgcaacaaatacgagtaaatgcacataattaaaaacgagtatttacacgtgtctaaaaacgagtatttacacgtgtctaaaaacgagtatttgcacgaaaataatcagaatctaaataaaaacggttatggcaacaatggcggagaaaatggcggcttcactggaggaattaagaaagctccaggagaaagaccgctgtgtcgtcctgcaagggacggccgagatagggaggacgcatttaacccggctgttggataacggctggttgcaggaagcctaatccgaagccgtcttttgcggcggcatttgaaagacgttcaaatgcaccgaatactcgttgttgctcatcttcggtcatgcccgtaccggtatcttcaacgataagtttcagcaaaccgttatcataatccgctgccaatgatacactaccgttatccgtgaacttgatggcgtttgacaacaagttgttgccgatttgcaggatacgttccttgtcggtcaaaaccaccgcatcggtgtggctctccactatcaaagtcagccccttgttcatggcaatgggcatgaactccgtttcaagaatatgcgtgattgcggaaatcctgcaaggggaaaggttgggttgctccttgccgttgtccagacggaagaaatccagcagcgtgttgagcatctcccgcatacgctcggaagattgccggatattatccacatacatggtgcttttatccgcgctacaacttttctgcatcagtccggcatagcctcattttgtcaatcgtattttttcgtggtagaagtagtttacgatgacaggtttgcctttttccgagcgtccgtatggcagatcgtttatacgatacgggaagccctgctccttggcgtaatttgaaatgtcctgctccaatgcctgccagtattcaagcctttttttattgtaaatttcctcgtaaagcggtatgaggtcaggatacttctcacggatatacgtcattatcccgcctttgaactgcccgcgtaaattcaggttttcaagccagattaaatcagcataatcttttacctcctctattattgcctttacgtctgttattctggggaatatgggcgagacgaagcatacggtgcggatacctgcctcgtatgtctgacgcatcgctttcagacggcgttcaatgcttacggcgttgtccatatctgcgcagaactgctcgtcgagcgtattgacagaccatgacacagtcactttgggaaaactcttcaacaggtcgagatcgcgaaggacaagatcggactttgtgcatatcataatctcggcatcgcttcctcgcagctcttcgagcagccttcgggtacggtggaattcttcttcatacggattgtaaccgtccgtcacagaccctattacaacacgttcaccgtcgtatttatgaggattcgttatcggcttccagttttttacatctaaaaacgtaccccacggctcggtgtgcccggtgaaccgtttcatgaacgatgcgtagcaatacctgcaggcgtggggacaccctacataagggttgaccgaatatcctcccaccggcagagaggatttggtcattacactctttacatctatttcctttattgtatccatattcattgtattcgtctggtaaattgttccggcaattcctgaatcattctttcgtcgcccataatcggcagcaaatcctctttcatgaacaccggtatgccatgagcctttgcctgttctgcaatgctaagcacccattcggggcgcgaatatgactttccttttcggtttccggtctctgtgcctatgacaatccagtcaattccctcgaaatcaatctcgccgatatcatcgaagagaggttcaaacgtgacatggtagtgtcgtgctttgatattctttttcaaatcatcaatcctccttttctcggaactgcgcgtaacggtcacgcccatccatacgttctcgtcgtcagaggagaaactgattttgtcagggcgcttcgtcagaaagatataggcgtgctggggattgctgctgatccgctcgaaaatttctgcgttccattcaggcttccaatcggagaaatcgctcattcctgtcatgagccacacatgaggacgggacgtatcgatgatgcgcagttttcgttccatgtattcaggcacggaaaagtcgtcggtaatgtggaaacggcggcagttgttacgggcatagcagtaagggcatcctatagtgcaccctaccactatgttcatgttttttatcagggatttaatgcagacactcataacacaactgtttctccgtcctccgggataatcagccggctcatgtcggcttcgtgatgcgttgcctcattgcgcagaattgcacgggtggtctggcaatggtcgatggcatccatgtgtacggctatcagcttgatatgcgaaggcaattcgtcaagtatctgcatcacttcgttctcgtcggggatgataggaccgtccgttttggaaaattcgggaaagattgcacctccggagtttaccacgatatagtcaggattgaaccgttccacggtgtctcggatacatgcttcccatcggcagtcacccattatataaacggtcgggaagccctcggcttttagcacataacctgatacaggtcccatcatctgcccgatctgcccgaaaccatgatgtccggtcgtgcggtaaatggatatgccgtctattgtttttatttcttcgatgggtatcacatttgtaaatccgtcgtttctgatggcgtccgcgtcctggggctgaacgtagaaaggaatttctttgggcaaatgtgtggggacactcggctcgtaatggtcgatgtgattgtgggtcaggagcaccatgtccacgcctccgataatatcctgaataggaatggtgaggtgtaccctcggtgttttattcacaccgagggccgatatcaaagtgcctttgtcggctaaaacggggtcaattagcatggtgtgtcccgcatacctgattttcaaggtggcattgcgcaccaattgtactgtagatgtctttttcatgactatatgtcttgttattgattacgggtgcaaagttcggaagaatccggcgaaacatctatgcctgaaaaaacggtaattatgccattttgataaatgaaattattatctttgcaaaaacgacaaggatatggacgagataatcaaccctgatcgactggtcagcgtaccgttcaacaagacacgctgcggcgtggatttttacatcaatactgccataaacaaggacatcggacttgtgctgacagaaaacaagcggtttaagacagacttcttcagcttctactttttccgtaaggcaaacggatatttgctactgaacttccgcaagattgaactgcgcgacggcatggttctcctgctttcaccccatcagcaacaagagtggcatgtagatgagacggcgttggattacacgttccttatattccgcgaagatttcatgcgtacttttatcgccgacaagttcttcgtttttcgccttttgtattgttaccagacagatacgccgccttacatcaatgccacacatgacgaaatgaaggaatatatgcggctgctcggaaagattaagtatgagctgatgaatccagtgtccgatacgtacaatatcattgtttccttactatattatcttttgctgattatcaatcgtacatacgctgccgcctattgcttgcccgctgaaattgctaaaaacaatttcgcttttcggttcaaggacttgttggaacagaatatccgcacccaccagcgggtgcaggaatatgcagacatgcttcatgtcagtcgcatcacactcaataactcagtaaaagcccaattcggagtatcagctacccatttgataaaacaacgtctgcttgaggaactgaagaacgaattgctattctccaaccgcactgtcagtgaaatggcggatgatttcaatttctctgatccgagccatctcatgcgcttcttcaaacagcaaacaggcaaaacatttactcagtacatgacggattacaataaaggcatatacgaataacttcttaatatagtcgatagcggctatcgaaatatggttgttgatgttcaggcgtttttgtactgcatgaaccattttacgatttctggatcttcgtgcgagccgagtaagaaaggcttgtcggtatccagcgtctttatccgtgccatgtcgtcggccgacagggtgaagtctaatatgtcgagattctgcttcatgcgttccggtttcacagacttaggaataattatgcacactgatatttatcgcgcccggacaggtgttcggtgcggaagatgacggcatgcagttccaaccagatggctacctgcttatgttccatcccgacctgctgcggaatacacctctcgggcggataatgcgtgaatattcgttcttttcctacgagacaaacgaggcattgcaccttagtgtggaagaacggcaaatcatcatggattgcttccacaagattcaatatgaattgaaccatccgatacaccgtcacagcaagaacctcatcacagacagcatcaagacgttccttgattactgcacacgtttctatgaccgtcagttcatcacacgcgacaaccaaaaccgagacatcctcgcaagatttgagcggttgcttgacgaatacttccatgatggggctgctaaacggataggcttgcccactgtacagtattgtgcagacaagctctgcctctcgcccaactatttcagtgatttattgaaaaaagaaacaggttcaaccgccctgcatttcattcatgacaagtctattgaaatagccaagacggaacttgcatctacagacgacaccgttaatgaaatcgcctataatctcggttttcagtacccgcaacattttacccgactgttcaagaaagaggtaggttacactccgaatgaatatagagcgcaagtgtcgtgagaattggattagtacagaatattagaacccaacacctctcttgcgcttaactttcttccttctgcgaagtatatccaccatttcctgattggcttccgcatcagcagtgttataagatgagccactgctttttagcaatccccaagagccgttgaacaactcgctttgtgccgtgccggacggtgcgcttggtgtagccgtttcatatattccggctgttattcccatacgttccctgcatctgttgtgctgcaaagccgcgtcaatcttggaataactgaaacgcctgtccactttggagccgttgaaatggtagccattcatggagaatacaacaccctgcacctcgctggtctgccccttatgcttgaaatgtacttccactccctgccgtttcaggttggcgataagcacgttccagttgccgcatctgccgacttccattttgatgatgtcgtaaagcgcatatttcgtcctgtctggctctttcaggcggttgcgtttgacattgtcctttccgccagccatatgcaagccgtatttcaaggtcaattccttgcagatgcgggtactgcgcagacgctcgtgcctgtccgatatggtattgccgttgttgtctatgcggttgaaagcaatatgcacgtgcggatgctccttgtcgaaatgctgggcgatgaagaactgcgtattcttgattcccatccgttccatatattcaagcgcgatgcctgccatgatacggttcgtcagccgtaactcatcctctttggaaaaactcaacgcgatatgtccgacaggttttgtcaccttatcgttcatccgtgactgggcattgaaactcatggcgatagtttccagattttccataaacaagccttcgcttgctactatctgcgtatccttcttcttgtcgatgatgtaatccaccgcacccttgaagtcgcttccttttacgattttcgccatcatatccctatcttggttataagttcatgaatccttgccactgccaccttgcagtcccaccgttcatcgtggaagcctccggcgtttgccttacgcgcaagctggttgagattgttagccatgccgcagagttggcggatgtatccggcatgttcctccgacagccgttctttcacatgaccgttacggaaacattccctcatgtactcgcttggtgatacgcccgcctcatgcgatcgtgtcagcaggcggaagtagtcggctgccgtcattttcactgcgatacggtatttcagtttctcggttgctgttaattctttgtattttcttacctgcctcaaatccgcaactaagcccttcaacgtccttcttgcgtgtacacgtcctctcattactgaattatcagataaattgaggcagaaacacccacttctgcctacaacatccccttaccccacaatgcgacttgagacaatacgcagtatcatacccataagttgtaggcgttatccaaaatcagtctgaaaaatatctgcgtaagcattgttacaggtatagatattcagcacataccgccttgatgtcctgatccacttggctggtacagagataaacctgaagacaaacgcttttatgcgacttgttgcattgagtccgaacctctttacgtcaagtctttggataatggccttgtagaagttacggataagtgctgtaagaagaaggaacacagtgttctcggccatgaaggatttgggcaatctgtcccacccgaaaccattgttcatatcatcaaagatacgttcctttcctccacgaaggttatagaactcgacaatttctcttacggaagattcatagtcgttagtcaggatacaacggtatgtgtattctccttcccaaagatcctgcacaccatccatccgtttctgtctttgaatcacaagtcggtatgctttacccttccacttctcaacaaggatagagttcaattcaaactcaatgccattgatttcctcagtcttccagcctctgagagcaaatatgtcattgtagagcgaactgcagcggttagtgcggatatagaaggacttgcagtgtttctctatttcctccacgatttcctcggaacatgatccgcaatcagctctgaaacgattgatagtgagcctgttctgttcaaatctctcaaagaacctcttcagcgtgtccttctgatgaaaacgaaggttttcgttaagccagatgagcagagctaagtttacttaagctctgccatggcgagaaaacgtgccatgaaatggaacttttgtgttaccatcgctattctcaatgccaacaatcaagtcaccaataaccgccacgccagggcgataaccagagaacttcttgtatgtaggctttgcatcatacttctcaccctctttcagttggtcagatgcaaacatacaattgagcagtaaagtattgagagtgtcagccgtgttgaaatcgtagttcttacccgtatctgatgtgtatgagatgttttcttgcgtcagttcctttatcgctctgaggatagtatcagaactacaagtatgaagtgtcggatgaagcgagagatggttcatcaaatgagtagtgacatcctcaatacatgagccaccacagaagtagatactcatgagagaacggatgatttcgctgtactgataacctaacgatctacaccttagaccgagggttgagtcgattacagatgacaatgtggagtcaaattgctcatcaggtagggcggaaggatttcgaggaatttggacgacgcatagggttgggcaataaattgataaagcgtgagcttgatgagtttgtcaaagagaaaccattggtgcaagtattgatagaccgttcctttttatcggaagaactgaaaaagtaatataggatgtctatggggtacaggtgtaagatgctttctttctgatgaagggcggataaagcattcttcaggaaagtacttctccttttcccataccggtcataccgttaaaactgattgataattatgacgcgtatgttggccggtatgcctatctttgtggcaatgaaaacagagaaaggattgattttgtaagtattatcatggcaaaagaactgattcgtgtccctagggtgcttggggaaagctataattccgtgctgattgaacggttgtatgaggcaggtggaaatgtcatgctcgatctgatcatatacctgggcagctatcacctcaaagacttgttcgggacttcctggttctccgtagaagacttctgccgtaagatggggtatgaccgtaccaacttgcagcgcaagctggatagccggcagctcgcggccatgttcggaaagaatatgcagccggaatatgtatgtaccgacacggcaggacagagaatcagccatcctatcgagacggtttttgaggcggctctctataaactgggattggagaacctctgctatccgaccattggcgaggatggccgtacatcctataatttcgtgcagatcttgaaacgtttcgacataatgaccgatttcaagacgaagaagtcaacgaaaaggctgtactcggcagtggtaagcccggagataaagaatttcatgttctcgctctataacctcttggaacttcaggattaccgtagcctgcccagccgttaccgctatttctatctggaactttccaagatggtttacctgatcaagtataagaccaccaagaatgaggctcctttttatgtgctgacagtcgatcagctggctaaaaagctcggcatagagattgccgaacccaaagaccggaaaaagaaggtcgcctcgatactgaaaaagatgaatacttacctgaaatataccaatttcaatttctcttttgtgaaaggcgatcatgagagatgggcatataccgtgttgttctcgtttcctaggcatacgctgcactattttgatgaaggacaatatgctgtcgtggtgaagaaattctataagaacctgcttgggctgtatgtcgagattgcctacccggacacggatatggctgtcaggaggaagaagatcaaagaggtggaggaagatgccggactgtataaagagttccttttatgggcaaactccccggaaagcgtagaaaagaagaaacagatatatatcagtgatttcgtggctgtattcggcaggtttccggaaggatgggcacaggaagagttggagagtgccaatggaacggaagttgctcctgctcctgaagagttcatatctccggagacggacggggcggtgaacatggacgatccagctgtgtagaaccgtccacgtttcacggttttttatagaattagttgtgtagaagtgtccctattggggtgattagatgtgtggagtcatccgctttgcctgttttagttgtgtagaagtgtcccgtttgttgcttctagttgtgtagaaccgtccactccttttgctttagttgtgtaaaagcgtccggtttcacttgtcagctgtgtaaaaccgtccacccgttaatgaagggaataggtaatccctgttttttttatatgtcggtatatcagtgaaataaaagagagaaatttttaaataaaaggtatcggctgtgtaaaaccatccaccaaaatacataataaagacctaaactcctaacccctttaaatatccccaaagcgataacatagaaatgactgggaaaataaattttcccttcacatgccctatacgtactttcggaaaaagatttttcggaagtatgtgttgattttcacgcttttttatatgattggaaggcggttctgttcatcttctgtatccgaattagtttttcagggcgttcccttctgaccgggctattcgttgcaagtcctcgttaccctccaggcttttccctgctatccctaacgctctacgctccggctatgccggaagagaggtatgatgattttttcctgaactgataggaacattgcgaaggtaggcgtggccggaacgcccgatattgaaaagccaaatctccatcctcccattccgggaggtagtatttaccagttcaatcccgttctgatccgtctttcccgctttctcttcaatgcactgttcccaatcagttgaggaaaaatttatggttggggcgacaagcgatgtttgcgagtattaatcttttaatttttggcagtatgaaaacgaagagaaccgtatttgaagtgaatgacgtttatcgggtgatggaaaacagcgagttgatttataccttgacgaacagtgagaaactgaaacgtgaagaatataagtatgaacagatggaaatagaaggattgtgcttgtctgatgtactggaaacactaacacccagccgtaaaaaagtcgcttatgcggcgattgagctatataaacggctgaaagaagggcaagttgaaagtcctgcgcttttatccagcaataatgtttataaaatgatgcatcctgttttgtgcgatatagctactgaagagatgtgggtgctgttgctgaacagttcgtccaaactcatccgtaaagtccgtatctcatgcggcgggataaataccgcccctgtggatatacgggttatcatgaagcaggcattgtattataacgccgtatcttttatcatggtacataaccacccatcaggagcacgcaagcccagcagtgcggatgaccgcttgacggaagcagttaaaaaagccgctgaaacattagacatccgtttggttgaccatgtgattgtggcaggcaataactattatagctatgcggacgagggaagattgcaaaataggtaaggtggacgggagaaatcccgtctgcccgggatttcggcttcggggttcttttttggcagtcaccccaaaaaagaaccaaaaaaatgcttcccggactatcggatgcgacatcgtaaaatacgcaaagacgtggcttttcagaataaatacatatcttcgcgccaaaggtgatcggaatgaatgtattttctacttttgatacaggcgttatggtggctctcttactgggcattgagtttcttagaagtgatatccgaacgattctctattgtaaaaggaatgatcccaggattcttaagagttgcttatatacgctgcttatattattgaccagcctttattctattgtggccggagccatgcttcatccggaacccgtacctgtttatgagttgatacccggttttcaatatggggtttatggcttttctttttcgtttatattgctcgctgttgcatgtctttatcgtaaaacattaccttttgtccttttgggctacgctatgatatatgtgatcggtgtattgataccactacttaggtatgtagtgtctatgatggattatttcactcgcacaagggtatagcaggttaatttcttgattgtatcggattgccctttctgtgggctgcctcccccggcttctttcctccgatccgagtccggctttttgctcggcaaaggtttcgggattccgcaaatggcaagttacggccatgcgcctttactgtatggaaaataacgatgaagaagtgtcttcccgacattttccataagtgaaacttggcttattgcttgcaatccagaccttgatatgccgaaaaaaggctcagaactcagatggggaatgacatcaaaaaaaaggtcggctgaccaaagaccttcccgatacaaaaaatgaaaaggtcttgaatctagctgaagaataaatcagatgttcaacttaaataatgctaatatggaaaatttgattacacaaatcaacaaagagagattggttaatagcgacacagctcttatgatgaaggaattatactattacgtgccttgtgagtattggtatgacaaacaggataggctacgcaccgatattgagggaaggaataccccgatgtatatgtgcgagtgcccgacactggcagcatgtatccaatggatgatacagactcgtgaatatacgtttcaaacagaacaaaacgtggcggtctggcatgtggttgtgagggctggagattatgtgttgtatgactccgaaagtaatgcggacgctttttgttgtttggaagaagcattggaaaaagcggtacaggagtgcatggagttattgtattaaaattaaaaaaaatcagtccccgtgaaggggactttcctataatcttgctgagaggtggaattgcagacgatctttgagaatcatctttgaaggatgggcagaggtttattcgttatttgttatttttgttctcggatttcagcgcaattccattccttcttaataggcgatatactgttccgctactgcctatgtttaatattttctgtatctcccttaccggcgttccggattcatagagttggatgcagcttttctgcttggcgatgttgtttttgttgataagtgtctttctgccgaatttgacacctttttccttggcgattcttctgccttcttgggttctctcatagataaggtctctttcaaactgagcgaaagcaccgagaatgttgttcatcagttggccgattgcgccttccgtactgatgttgtcttgcagtgaggtgaattggatgcccctattcttgaaatcttccaatagcgtaaggatattcttcagcgaacggccaagccggtccagcttatatacgacaagtgtgtcgccttcccggagaaagctcaggcaggcatccagttccgggcggttttgttgacgtccggtcattttctcagagaagattttctcgcatccggcagccttcaacgcttccagttgcatatccagatgttgttccttggtggaaacacgggcatatcctattttcatcctgttttcgtatttaaatgtgtaatgaaggttttaattcttcactttttcaaatatgaagacattaattcttcatattcctcacggctgtattggttgaaccccttttgcttcattgccaaaagaagcctttccagttctccgatagtcactacctgtttgccgataacggtaaattgttcccattctcccttttcgttgagcaggtattcccggtgtgcaaaacagtaaagagaaccatcgatgtcattccgtttctgccattgacgcaggtgcttcaaactggtgaaatcacgggtgacagtacgtggaatgggaaccaatacgtcaatttccatcttgaattttatattctcttccgcttctcgcatgggtgattagcttatttcataatacatcaattatcgtatgggcaggaagttccagtttggagaaagcaaacattttcttgcccaaatcctttagcgatgccccaatatgatatacttccgtattatcaatgattaagaagcggtcatgactacttttgtaggttctagcttcaatgggaggatattggtcattgtgtttgtttaaatcaagttggagctgtgcgtttattttgtgtataaatagtagctgatactccactgtttcgtttgctcaacatgagtaacacggattcatctacatagttgtcgataagcacaagtgagcatttggcagactttattaaatctgtagcaaacttatacgcatcgaatatctgaccgtcaaagaatataccttccaccggaggcaatgaggtgcgtacaaagaagtctatctttgcatcatgttcagcaatggttttctctatttggaagaatctattgttcattctatattccatgtcattgagccgttggtttatagaataacctttcaataaatattcttttaaaattttatttgcccattgcctgaattgcgtacctcttacgcttttaactctgtatccaactgaaattattacgtctagactaaagaacttgacaggcttatcggaattagcaatgtgcaaaaaatgcacattgcttttctcttccaattccttttccttaaaaacattatttatatgtttggtaataacggttctgtcacgttgaaaaagttctgctatctgcgcttgtgtgagccaaacggtttcatcttctaaacgtacttccaaccttacagcttcatccggttggtatagtatgatttctccttgcttctccattatatgtttcgcttttattatattgttgcaaatgtacgaaaaagaaacgttataaagtctgttttttccgtaagtattaccttaaaaatttgttccctttttattttaataaaacagaaacattctgctgttttaaaaatcagttatctgtttgctattcatagttagggtatcaaataactaaaattcaaatggaaacgcaaatctatattttatgcagatttgtttgttagaagcggagaaaaggacacaagacatgataagaatcataggtcggggagcgccgcacggcaaggggggcactagcctcccgacgagtgcagccgttggccgggttatcggtgaaaatggaaaaaagttggcttttcttttggtattgttataactttgtctatatttgtgttgtgataatcaattttaaagttataacattatggtaacaaacattattcagattggaaacagcaaggggataatacttccttccgagatattgaaacagttgcgtttgtccttgaaatcggctgtgagcatttctttggacgggaacaatattgtgataaaggcacaaccacggcagggatgggcggaagctgccaaacgtgcccatgagaatggggatgatgagttgcttatccctgatgtgtttgaggatgaaaagtttgaggattggacatggtagaacagtatggagtgtattgggtagagttagaccctacccgtgggggtgaaatggcaaagacacggccatgtgttgttgtaactccttcagatttgaatatgtaccttacaatagtagtcattgctccgataacctccaccataaggaactatccttaccgggttctgtgttctgtagccgggcgtgatggggagatagccacggatcagattcgcacggtggacaaaagccggctgaaaagaaagattggagatttgaatttcagtgagataaaaagactgaaggaagtgtttcatcaaatgttctgtgaataatggaaagtgtgcaaataacaggttatgtagcgtattcaaaaaagatattatgaagccaactacttatattaattgggacggtctgaaagacattccattcttctactgcgatacaaaggaagatgaagaaaacaaggatttcgacatctattaccagggcaagctggtgttgcatgactacaaccattgcggacactacctttacactgctgcgctgctgttcagtaaaatcagaaacattacagccgactgggtgaacctgcataacctttggattctgcgtgattgcgtgcgcgagaattacaatcacggcataggagtggacgaccttattttcggagagaatttcgatggcaagaacctcgatacactcacaccgcttaccaagaaacgctttgattatttgtgtaagcggattaaggaacttgacccatacgcaacaatttaacacttcattgggcgaaggcagggcttgctgcggatgccagactttaaataatccattggattaattatctttgcacgctaattttcaaattataaagaaatgactaaatcggaaatcgtaaaggaaatatctgccagaaccggcatcgacggcaaagcggtgcttgctgttttggaaggattcatgaacgaggtaaagacttcgttgggtaaggaggaaaatgtctatcttcgtggattcggtagtttcatagtgaagaagagagcgcaaaagacagctcggaatatctctaagaatactactatgattattccggctcataacataccggcatttaaaccgtctgacgaatttttgaaaatggtaaaacaacagaacgcataataggtaaacacaatgaaagatcagttacgattattgagagactgtatcaataatgatcgtccggcagttgtctttcagggagacgatttttgcgctcctgagattttggaagcagcaaaagaaatttatcgtaaacatggttgttccgaagaatttctttttgactggcagctgcttatcaatgaggtgaaggcttaccagttagaaagtccggcaactgtcaaattgccgaaactctccccgacagaaacggaactggtgcgggaagagatgactaaacgctaaaaaatattctcgtttaatacgcaccttttattcttcaggcagcgtattgaacgggatgggattaaaatgttggcgaacctgcttttttcgaaagttcctgccaatagttgaagtcactcggtgaaagatgctcttgcatccagtcacgcataccaatatcgtttctttcgttcacatatctcgtaaacggaatcattgtcttacatgcttcaaatccaagcattctcatatggcgtgaaatgttgggaggaagaccttccaaccactctttataatacattatcaatctgttttcttggattggaaccgcttgttggtggtaaatatagctggcgtttccgattctaatatctctggccttattttcccgttcttcttcaggtagccgacttaaatattcagcttgtgctattctgcatttggagtttggatgttccatggtattttatataattaagactcttcaatgatacggttcatcaaatcacatattttttggcagctatgacggtctgcgcaagcaggataggggcatttctcaaaggatgcctgattatccgtaactatgaaacctccggaacgacgtacataacttaccggatgaaaataaatatcttcctttttcggcctataagtacatagtcttataaggctgttcagctctttgcaaatttgctcacatttttctttgggataatgtggcaaatcactgaatgcttcgtaggggacaaaggcaaatgctttgtcatcccacatgacaggtgtgtaattctgtaccatttgttatttggaataaggatggctggcagattccgtatttctgtatcagttaggtaatccgtcactatttaagtgcgcctgggcaaactcccggaggttcgtttcggcaatgcacttttcataaatctcatccaatacttcttgcatattttctactttattgaattttaaggggctgccgtttgttgcggcttgcctttccagttgttcgatgatactgggaaatatcccacgcaataaaccgacggtagctacggctgtagctggttctacctctattgtaatctttttcttttccatatcgttgtattatgttatcaaaagtaataattattaggatattggtaagcatttcttctgaaaaactttttaaagatattgttttaagatgacatactgtgtttttgcgttcacgcagtattctttcccaccctccccttcatcggaatgactgttctcatttccggtttacccgtagtcatccgctatgcggctgattatgggcaaaccagaaaagagaagttccgactcgccaaattatatgcataaaaagaaaagccctcagatttttacattgatcccaaaaaaagaaggtacccttttaagacaccttcttttgtgatcgcgacaggattcaaacctgtaaccggctgatccgtagtcagctactctattcagttgagctacgcggccattagttaaactttaaagtgatcgcgacaggattcaaacctgtaaccggctgatccgtagtcagctactctattcagttgagctacgcgaccattgtttttgtttaacgggtgcaaagatacggacttttcttgaatttgcaagctttcagcaaacttttttgcaaataaattattcgatgaaacgatagttaaacaattgccaaccgagcgtcaaaccgacattccactcccttttcggtgagctataatgatttacatatgccgagattgcaccaaacggtaactgacataccactgaaacttctcccaaatattcgaaacgagagaaagcttttccatagtaagccttattaattggatttctttctataggaaaaatcggcaaaaagccataaaactctccacgaacgtgaaacatctgatttaaacgataaataggccgtatcccggctgccagatattgattggcacgaaaagcttcattatatgttaatttactatgtgcagtaggtgcaaattcactggcctgcatcattgtagctgtataattctctgagaagtttttagacgcatataatgcatccagataccatcctaatgtccaatttgctcccattttatggtatttctccttcatataagataactgtaaccatgaatgtttctcttcggtagatttcctactctcagaattcaccccagggcgaaagcgttccttccctgtaaatatctgtgcaacgagtgcctctcgtgctccttgagtaggaaattgtctaaaattcaatgtactaccattaaaacttactgaaccgccaaacaaacgatattcacttttatcatatttgtctttatcgaagtcgattacattattttggaaataccggtcttctatttgtgcaattccaaacccaagctccactcgtttacttgaaagaaaaggaagagcaactttgagtttcagaaaacgctcatctttttgattaaaagccggtttatcatttttagagaaaagcttatccttcttaaaataatcgaaagtactgatcgaagcaataaagcgataagaagtaggaatagtagtggcaaagtctacttttgccataaactgagcattattatatatttttcccaactgtccatcgaatgtaaactccttcgaataatagttaagattctgatatgtaagtcccagataaatttggttagaactggtagtggacacatttccacccaaacgaacagaaaattcattttccatctttatcttcaaatgcaaatcgtaagtatcatcttcggggttgaaaactgcatgaggaataatctctgagatcatattatcagataatagacgaaaatatccccgtttcaaatcctcataggtaaactctttatcatctgaagtatggaattctttctttatgtaaacctgttgatgagaattagcaccatcgatatatatatttttgaaacggagttccggataattacttttataaaccaaccgcctcagtcgtatattatccatatttactctacgatgaacacgacttttgatagaatccattaagcccatggtccgatcatatcctattttcaccagttcatccattcgttgaaaatccatcagattaacatcgttgtacttaaatgtcatcaatattccagccgaatccggaagagaataatcagtcttttgcattaccatattctcaatctgactcatcaaatcattttctttcggttttcctgggttggtagaaacaacactacctataattatatccggatgaaaatcctctcgcatgacatctgtaggaaagttattataaattccaccgtcatatgccaataaactatctatttcaatgggcttaaacataaaagggaaactcatagaggctcgtactgcatctccaagatcaccacgctttaagacaagttgttttttattatacacatcggaagctatgcatcgaaaaggcacaaacaacttatcaaaatcgccttcacaagtggcagttgcccgtgcgtaaagatcgataaagacaaggttcatctgaattggattaaccacactggttggcaaaaactgtggctttaaattaagtgaatctttgaacgaaaagcgtatattgaaaagttcaggagtcggaagattctttttgaaataatacatatatttttcttccacttcaccagaataccaacgtttaaagtcatctgacttcagcaatatctccatatcatcaggtgaatatcccatggcataaagagaccctataatagctcccatagaagtacctgtaatataatcaattgggatattattctcttccagagcacgaattattcctatgtgtgtcagcccctttgcaccgccaccactcaatactaacccaactttctgagcgtggacaagcattggcaagaacagtaaaaagagaaataacaataaaaaaactttcttcataaggctcagcaaaacatcgtgtaaatggttgatttaacgttcaaatatatacaatagtttctaatctatcgactctgacagcacatttattaataaaaaaagagcattacggacacttttatcgtgcgcaatgctcttttaatttatgttatatgaattaaatgtgatagactaaatcaactcaatacttctttttacaaaattattcaaggcttcacctttcagcatgttgttctgtaataatgccaggtcaatcagctgacgaacaaccttattcttacctgcgtatcctgcaaatatcgattctttttgttgtttcaaattatcccatttcttatccaaatcgttaagttcatctttttcagcaacaggaatatcttcgtcttttttaccttcttgttttttcttgagtgcatcacggcgttttgtcacttcatccaattcagcttgtaccggtgcaatagctgcgctacattctttctcctcgtcagacagcacctcttttaccagtttgtgatctgaattcaataccagattgaacatatccggcatttcgccataaaaactcattccagcctgaatatttgccatctccttcatgcgacgcatatattcactttgcgtaatcattacaggagcaccattttcgcctaatgcctgagtcatcacattaaactcaaccttttccatctttggcaactggctcttgaaagctgcagtcagagcttcttgcttagtggcttcaagcacttcgcttttcttatcttctttcacaatcagattgtcaataacatcactgtctacacgagtaaagcgagatttctccagtttttgttcgagcatgctcaccattgccacatccaactgcccatccatcaacaatacattatatcctttatttttggcagcttcaatataagcaaactgttcatctttattattggcatataaataaaccagattcttatctttatctgtctgattatctttaataagagcctgatattcttcgaaagtgtaatgctttccattcgtatctgtgaatagggcaaatttctgtgctttatcatagaaatcctcttgggtaagcattccataattaataaagatctttaaatcattccacttttcttcaaactgtgtacgatcattcttaaagatagactgcaaacgatctgaaactttttttgaaatataagtcgagatcttctttacatttgaatcactttgtaaatatgaacgggacacattcaacggaatatccggtgaatcaagtactccatgaagtaaagtaaggaaatccggaacaataccttctaccgaatcggtcacataaacctggttgctatataactgaatcttattcttatttaagtcaatattgctttttactttcgggaaatagaggatacctgtcagatggaacggataatccacattcaaatgaatccaaaacaatggttcatcagacattggatacaactcacgatagaacttcttataatcttcatcagaaagctcactcggttttttagtccacaaaggagtagtatcgttgattacattatcctcagtggtttcaacctgcttgccatctttccactcttttttcttaccaaaggcaataggtacaggtaagaagctacaatattttttcaagagtgcagagatacgaacttcttcaaggaactctttgcaatcatcatcgatatacaatacaatatctgttccacgatcggccttttctatctcttcaagagtaaactccgggctaccatcacaagtccattttaccgcttgtgcaccttctttataagatttggtaatgatttctacctttttagaaaccataaaggcggaatagaaacctaaaccgaaatgcccgataatggcattagcatcatttttatacttttccagaaagtcatttgcccccgagaaagcaatttggttgatatatttatcaatctcctcagctgtcaaaccgatgcctcgatcggaaatggtaatagtatccttgcccaatgaaacatgtacggtcaaatcacccaattcacctttgaactcactgatagaagccagtgtattcaacttctgtgtagcatcaacagcattggagactaattcccgaaggaaaatctcatgatcactgtacaaaaactttttaatgatagggaaaatgttctctgttgtaactccaatattacctttttgcataataacgtgtattttttaattatctggttattaaatcgaattattttttgtagagatacagacaaaaaaaatgccagacccgaaggtctgacattttgacgtatactcaaaggaaataacttagctattcagtcgttttggcttcatgattcatttccaactctcctttttcttcgttcaaagaaacagttattgtatctccttctttcaaagcagccgaaatgatcagttcagataaaccatcttccagataagcctgaattgcgcgcttcaacggacgggctccatattgtacatcgtagcccttagaagcaatgaattgcttagccttatcctcaataaccagcttataaccaatcgaatctattctatcatataagcctttcaactcgatatcgataatcttcgtaatagcttccaatgataactgatcgaaggtgataatttcatccactcggtttaagaattcaggtgcgaatgatttattcaaagccttctgaattacacttcgcgagaattctttatcgtctaagcgactttgtgtagcaaatccgactccacggccaaactcctttagttgacgagtaccaacgtttgatgtcatgatgattaccgtattcttaaaatcaaccattctgccataactgtcagtcaaacgtccttcatccattacctgaagcaggagattaaacacatcaggatgtgccttttctatctcatcaagcaaaacaatggaatagggcttacgacgtactttctcagtcagctgaccgccttcctcgtatcctacatatcccggaggagcaccaactaaacgcgaaactgtgaatttctccatatattcactcatatcaatgcgaatcaacgcatccgaagagccaaacatatatttagccaattctttagctaagtgggttttaccgacacctgtcggtcccagaaacatgaaagtaccgataggtttattgggatctttcagtccgacgcggctacgcaaaatagctcttaccaacttctcgatagcagcatcttgagcaatcactttcgactgtaagttttctttcataccggccaattttataccttcagcctgcgccatcctctgtacaggtatgcccgacatcatagatacaacattagcaatttcttctgcatcaaccgtttcgcgattatctttcaaacgctcttcccactcttttttcatcacatccaattgagtggtaagttctttctctttatcccggaaactggcagccaactcaaagttctgcgatttcactgcatcatttttcttgttcttagcctcctcaatcagtttctcctgatcttcaatctctttcggaacactgacatttgtaagatgtacacgtgaaccggcttcatccaatgcatcaatagccttatcagggaaattacgatcagttatataacgatctgtcaacttgacacaagcttccagtgcagcatctgtataatttacattgtggtgatcttcgtatttatctttaatattacgaagaatctgcaaagtctcctcagccgtagtaggttctaccatcactttttgaaaacggcgctctaaagcaccatccttttctatatttttccggtactcatcaagagtagtagctccgatgcattgtatctcaccacgtgccaaagctggtttcaacatattggcagcatccatcgatccggcagctgatccggctccgacaatagtatggatttcatctataaacaaaatcacattcggattcttctgcaattcattcaaaatagaacgtattcgctcttcaaactgcccacggtatttagttccggccacaacagcagtcatgtcaagcgctaccacacgtttatcaaacagaatgcgggacacttttttctgaataatacgaagcgccaatccttccacaatagccgatttaccaacacccggctcaccaatcaggataggattattctttttacgacgactaagtatctgtgctaaacgttctatttcacgttcacgtcctacaacaggatctaatcgaccttcttcggccgctttagtcatatccgtaccgaagttgtcaagcacaggagtatcatttgtcggctttctggaagctgtctgtgcttgttgctgatgttcacccgctccatgagcggaccgagactgattcatctcatcttcatcgtcatcatcctctgtgaatcccatacctgcactgatatcaggttgtaacgacaattgttcaaacacctgctgatagtctacatggttggcttcaagaactgtagctgccaaattatccttatctttaagaatagccagcaaaacatgttctgtatctgcaacttgacttttcatcacacgtgcttctaaaatacataattttaatatctttgcagccccatttgacaatggaacgtcagcatcaggcagcagcatgtcatctgcatgttctttcagtatggcctcaatctgcttctttatgtcggtcaggtttgttttgagcttagacaatatctcaattgcttttccctcaccatcgcgaagcatgccgagcaataagtgctcagggcctatatagctgcttctcaggcggttggcctcttccttgctatatacgataatatcggaaactttttgtgagaattgattattcatacttttcttccttcttctaagagattatttacttgcaaatatacgcatttcatatcgtttgcttatgcatcatttgctttatttgttatataacaaatgtcgtgccattatttctttcatttctatacattataatataatagagcaataaaacacacaaaaactactaaagaaaagaaattgatacagccagtatacaagcatcatcatattataagaactaacttcggacccttttaaaaagcctaaaaactttcttcgttaaaactttcgtatatcaaggaaaagtagtactttagcgtggtttttcataagccacaaatgtataattaataatctttttaaatgcttgaacaagacagaattataaagattaacattgaggaggaaatgaagtcatcgtacattgactactccatgtcggtcatcgtttcacgtgcccttcctgatgttagagatggatttaagcccgttcaccgtagaattctttacggaatgatggaactgggaaatacgtcagataaaccttataaaaaatcagctagaatcgtaggtgaagtacttggtaaatatcacccgcatggagattcttccgtatattttgctatggtacgtatggctcaagaatgggcaatgcgttatccgttggtagacggacaaggaaacttcggttctgtagacggtgacagtcctgctgccatgcgttatactgaagcacgcttgaataaattaggtgaagaaatgatgcaggacctctacaaagaaactgtagactttgagcctaattttgacaacacactgatggaacccaaagtgatgccaacacgcattcctaacttactggtcaacggggcttcgggtatcgctgtaggtatggccacgaacatgccacctcataatctgtctgaagtcatcgatgcctgtgaagcttatcttgacaataaagatgttactgtagaggaattgatggaatacgtaaaggcacccgattttccgacaggaggatatatatatggtataagtggtgtacgtgaagcctaccttacaggacgtgggcgtgttgtcatgcgtgcaaaagccgaaatagagtctggacaaacacatgacaagatcgttgttacagagattccgtacaacgttaataaggcagaattgatcaaagcaattgctgaccttgttaatgaaaagagaatagaaggcatctccaatgctaatgacgagtccgaccgtgaaggtatgcgtattgttatcgatatcaagcgtgatgctaacgcaagtgtagtgctgaacaaactttataaaatgacagcattgcagacttcgtttggtgtaaacaacgtagcattagtcaacggacgtcctaagatgctgaatttacgtgacttaatcgtatattttgtagagcatagacacgatgtggtcattcgccgtacccagtttgatctacgtaaagctaaagaacgtgcacacatattagaggggttaattattgcttcggataatattgatgaagtaatccgtattattcgtgcagcaaaaacacctaacgacgcaatctccgggctgatggaacgtttcaaactgagcgaaattcaagcacgtgctattgttgaaatgcgtctgcgccaattaaccggcttgatgcaggatcagcttcatgctgaatacgacgaggttatgaagcaaatagcttatttggaaagtatcttggctgatgatgaagtatgccgtaaggtgattaaagatgaactattggaagtaagagctaaatacggtgacgaacgacgttccgaaatcgtatattcttcagaagaatttaatccggaagacttctatgcagacgaccaaatgatcatcaccatttcgcatatgggatatatcaaacgtacaccattaactgagttccgtgcccagaaccgtggcggagtaggctccaaaggcactgaaacccgtgacgaagactttattgagcatatttatccggcaacaatgcacaacactatgatgttcttcactcaaaaaggtaagtgctattggttgaaagtatacgaaattcccgaaggtaccaaaaactcaaaaggacgtgcaatacagaatttactgaacatagattcagacgatgctgttaatgcatacctgcgtgtaaagagcttgaatgatcagaaatatattaatagtcattacgtactgttctgtaccaagaatggtgttataaagaaaacatcattagaacaatattcgcgtccacgtcagaatggtgtaaatgccataactattcgtgaagacgaccgtgtaattgaagtacgtatgacaaacggaaacaatgaaatcattatcgctaatcgtaatggacgtgcaatacgcttccatgaagcagcagtacgcgttatgggacgtacagcaactggagttcgaggaatcacattggatgatgacggacaggacgaagtgataggtatgatttgcatcaaggatcttgaaacagaatctgtaatggttgtttcagaacaaggatatggtaaacgttccgatattgaagactatcgcaaaacgaatcgcggtggtaaaggtgtaaaaacaatgaatatcaccgaaaaaacaggcaaattggttacaattaagtctgtaacagatgacaatgacttgatgattatcaataagtcaggtatcacgattcgtctgaaagtagctgatgttcgtattatgggacgtgcaactcaaggagttcgtctgataaatcttgagaaacgtaatgaccagattggctcggtatgtaaagtaacgtcagagagtttggaagatgaaattcctgcagaagagggagagggaaatattccaagtaatccagaaactgacacgttggtaaatgaaacagaagaatagacataatattaataattaatcaaacaacaatcatgaaaagagtattattttcaatggtcttactgatggctgtaagttttgctttcgctcaagaaaagaatgtgaaagaagcgaaaagtattgccggtgaagtaaaaccagacttcgcaaaagctgaacagctgattaatgaagcactaaccaatcctgaaacaaaggataatgcagctacttgggatgtagctggttatatccaaaaaagaatcaatgaaaaggagatggaaaatgcttatctgagaaaaccctatgatacattgaaggtatacaacagtgtactgaacatgtataattattttgttaaatgtgacgaattggcacagattcccaatgaaaagggtaagattaaaaacaaatatagaagtgccaactcaaaaacgattctggcagaacgccccaatttaattaatggtggtattcagtattttaacctaaaccaaaacgaagaagcattaaaattctttgctgcttacgtagatgcagctacactgcctatgttagaaaaagaaaatctactggaaaaagacactatcttaccgcaagtagcatattatgcaactttggctgccgatagagtaggcgataaggatgctgtcatgaaatatgctcaatatgccttgaaagataaagaaaatggccaattcgcaatgcagttgttaacagacgcttataaagctaaaggcgatactgccaaatgggtagagaagttgcaggaaggtattgttaaattcccagaaaatcaatatttctttgctaatctggttgattattatagtagctctaaccagaatgacaaagcaatgcaatttgctaatgacatgttggctaaagatcctaacaacaaattatatttgtatgtaaaagcgtatttgtatcataatatgaaagattatgagaaagcaattgaattctataagaagactcttgatgtagaccctacatatgcagaagcatgctcaaacttgggattagtctatctgctacaggcacaagactatgctgataaagcaccaacagatattaatgatccgaattatgctacagcacaagccaacatcaaaaagttctacgaggaagctaaaccgtattacgaaaaagcaagagaactaaaacctgatcagaaagatttatggctgcaaggtctttatagagtttattataacttaaatatgggaccggaatttgaagctatagagaaactgatgaattaatctcactgatggattaatcagagatataaattacaaaacttgtctttaaaaagaggtatcacaagctaaagtgatacctctttatttttccagaaaaatataagaaatagtgtatttatcattatcaaaaaggcaacttacttaagtatagtaagttgcctttttctattaaacataatggttattattccattattttaaagcgcgcattttgagaacttgatcatccattaataactaagagcggtgtatcagaatgaaagatcatcttacgagctatgcctggattaaacaaacgagaaaatatattccgcttataagaagttaatgtaataatatcaatctgatttgttttaatgtagttttctaaactatttagaaaatcattactcattaccacatcataatgaatttcaagatccggatattgcttctggaaatagtctttaatgcctgccagttttatctcattccatgtatcttttacatctgataagtgaataagagaaacagaaaaatgaaatggatcaaatccattgataaatgaatcaaaagcaatcaaatcacgctgatcaaagtttgtcataaaagctatccgtttcacttcattaaaactattaaatggagtattctcagggatagccaatactgtagtatgactacgttctatcacttcagcggttacactaccaataagatcaatatctttttgatttttaccacgtgtacccattataatgattctaggacgatgttctttattataccgtaatatttcttcctcaggaatgccttctcgtaacacacaggtatatttcacatcagggaattcgcctgacgctaccttttgttttattttctctgataaagcattcaaatcatcatgaactttatgcaacacattctttacggtctcttcatcgctaatctgataattaaatacatcaccatatggcagtgatgaagcataaattggtgtaaagtaaacatgtaatagtattacctccgcatcataagatttcgcgaaattaaagccaaattcacaagccttcatcgaataattagagaaatcgactggaataagtacctttttagtacggtgttctactttaggcgccttctctcccactatactttcagcaagccaagctgaactttctgtgatttttaaagcacgaggtaagtcgctttctttaatacgcaaacgcacaccagatgacacaaccggttgtatttggttaacattgtgaatatacgtctctataccctcattttcaagaacattcttcaatatctgagcttttgtataagtcagaatagctaaagttactaatttgtcttccataattcgtttgttttattgaatttaacaaataagaaatcccaattgtttttgccaattgggattctgactttatcttttatttaagcctgcatagcttcggtagcttcttcttttctcatattcaattcatccaatatccttaatgcccgatcaagcacagtggtatcatcaatcataaccaatccaccatccggaccaggctcaagatgtattccgacacttttcccctccttaaagttatgaccaccaaaaaaatttctcaccgtgtcgacgtttaaatttagttcgtcggctattctatgcatgctaccgctaggcaatgaatctttaattttacgaagttcattaaatgttattgttctcatgtctcataaatttaatggttaatactacgtgactatattatcacgctataaacttaaggaaaaaaaaagataaaacaaaaaaaaagtgcttcttttttcgctaaaacaatctaaatcaatagtaacttcttataatacaataaagtccctcttcaataaatccaatactattaaagagggactttgataaaatatttatagattctattctcaaataatttcaatcgaactaaccggtacccatcctacctttccatcttcaagacgaatttctttccagtctttcatagagctatctttaatatcaactttatgcccttcatgaagaataaacaaactagtaccattctcactgggtgtactcctaaccgtaacacttggattcattatgattgcactatcccgatgcaataattcttctttttgcttagaagcaaaaacattggccattacaacaactattagaaagactatgcctgtaataaatcccactttcttcaacaccacttgttttgagaatataaagaaatagagagatacgattagcaacaggaagctcacaacaccccatacagcccatgcatctacgctcatactattaatcaatgctttggtccacgtcacaaagaacacctcgggcacagcttccaccttgtcaacagtcttaccacgagctatctctaaattagcacgaatatctccgttaccaggttgaagtaataatgctctttcataatttaagatagcctttgctatctcattgactttataatagctatttccaagattataatatacatcagctgcatctcctttacgtaatagtgattcataaatttgaattgcagatgcaaaatcatttcttatataagcactgtcgccttcagatttcgtagcatcctctaatttagaactggaaaactctgtattacgaatattgacagaatctccttccatcctctgagtagaatctgttactaatgaatcctgcccgaaagaagtcactgccactaacaagcccaaagtaaaaaacaatatttttttcatgactttatcttctctaatttagcgttttattgaattctccatcttactaaccacttccaacgatgatgaataaaccttatccatagcttggctttcatctcccggcgcaaaacgtgcaaactcacactcattcagagcagccaagaaatcttttatcaactcgtcactgactccatgatttctaagtttatcttccacattatcttttgacaaacgagaaaccggaatattaagtttatcactaatatacccccacaaagctttgagtacttcatcataaaatgcttctttcttattctctgcaagcaattttccagccaacttcattcgccttgcagctactttattagctttctttgtacgcatcttagctacatttgcattttctgcagcttgcttacggtaaactatgaagaatatgataaatataacagcaggaataatgtagaatagccaataaattaaagaaccgaataaaagactatcttttggctgaagcttaacatcattcaattttatatagcgaatgtcttcacctaatattttcagatcctctttatttgtaaagtttgcaataacctgatctgcatttcctgcccctttttccactttgacttcataatcttcagtactcagtgttttataagactttgactttatatcaaaataactgaaagaaactcccggaatcttataaactccagcatgtctcggaatggcaagatattcaataaccttactccctgaaagtccttcttgggtcaaacgaactttactgtccatcttcggttcatatacatcaaaatcctccgggaattttatttccgggttagctattaattttaaattaccagttcctgaaattaccagctttaccgttatagcatcattcgtctttacttctttagaattaatagaagaagtgatgctaaattcccctactcctcctgaaaagttagtgggtttaccagcaggcaacggagttacattaattgtaatcttgggtgtcacgattaccttactcacatttacataattgctaccgccattaaaaaaagcatcaaatggatcatcagattgtacagctttcgcgatagtagcatcaaaacgtgcaggttcaatcgtcagctttccggattgttgaggaaacaatacaaattgacgatatacagtcgtaaaataattccttcccttataatgttcctgtgaccattttgcattagccggcatttctatttcttgagaatggaatcccttaaaatcaggtagtttcacattctcaaatcgaagttgggactcacgagtataaattttaaaagttaaaaggaaagcctcctgttcatatacattagtcttattggctgtagcagtaataagcaaatcttgattggaaacggaagaggatgtcccagttgggctacttgatgacgaagcgctactactgccagtacttcctccagtcttatcgggaggaagaacctttatttttaccgaattagaaaccatctgatttccatctgccgtaatcgtagcacccggaatagaatattctccttcagccgtagccatcagaatataagtaaaagtaatactattattggtaaccccattaatcgattgcatacgttgcgaacgattaggtcccattaatacatcaaatccttttatagaaggcacacgaaaatcccttacttttatcgtatttactgtatacgataacctaaactggtcacccactactacagcatcaggtgcagatgcagtaaatactaccttcccatcagcccacgcctgtgtagtcaccgctaccagtgtaatcaataagaaaatcaattttctcatttcctctgaagtttttatcatcaattattttattattaccaatccttctctaaacgtcttccctgaagagtctgctgcttcttcactttatcttgaacacctttttcatcttgcattacagaattaagcaactgctctgcattttccttagacatttcattgtcgtttttctcagatttaggaggttgctgttgctgtttatccttattttgatcattttgcttattctgatctttattatcttgttgcttttgctgatcatctttattctgatcctgattttggtcttggttctgttgattttgctgttgatctttcaacaacttttgagccaatgccaagttataacgggtttcatcatctttcggattatttctcaaagacatcttatatgcttcaaccgctttctgataatctttaccagactggaataatactcccatattatgataaatctgtcccaacttggccttatctttttctatttgagttgcagctacatattgctccatcgcatctttaaacttttgctgttgcgacaacgtattacccaaattatacatagaaacaattgatttgggattcacctctaatgcttttcgataattaacctcagcatccacaaaaacactgtccttaaaaagacgattgcctttacggatataatcacgctcagctttttgtgcaaatgtacccagagagagggatagcaacagagcgaataatatatatttacttcttgacatacacattattacttattagaaaacaaccgaatgtttttaaataatggatttttacgatctaaaatcaacatctctaccaataataaaagcaatatcatccaagcaattacttggaattgttcattatattctgtataaaccttagactcaacatctgatttagccatcttattaatttcttgattaatagccttttgcgcagaatttgagttatctacacgaacataaatcccattcccgacctttgcaatttcctgacacatagcctcattcaaacgggtcacaattacattgccttcacgatcacggcgaaaatcgttactaccttcaattggaataggagcaccatcgggcaaaccaactcccaaaacgttcacttgaataccttttttggcagcttctttagcagcttcaacagccccaccttcatggttctcaccatcggtaatcactacaatagcacgtcctactccttcttgtggagtaaagctgcgagctgccagactgatcgctgcaccaatagctgtaccttgtttagatattaacgaaggattaatagattccagaaacattttagcggaaatataatcactcgttattggcaactgagtaaaagcatctcccgcaaatacaatcatacccactttgtcattctccataccatctactaatttagatataagcctcttagctttttccaaacgacttggctgaacatcttgtgcaagcatagagttagaaatgtccaatgcaatcataacctctactcctttacgctttacagtttcaagtttagagccgaattgtggacgggctaacaataccgcaaacagacttatggcggtaaataccaaccagaactttacatcgggacgatatttagatacatcaggcatcagttgtgccatcaataccggatccccgaatttacgaatagctttcctccttctatagttagaaaaaagatagaaggctaccaacaatggtagcaacaacaacaaatataaatatgcaggttcttcaaatcgaaacatctttctatctattttatggtatcttcttcaatattgagttacgtaacagtagttcaagcagtacacataagaaagcagccagcgcaaaccaacgatattcttcctgacgcttactatactctttcacgttcaatttcgttttctccaatttatcaatctcttcataaacctctttcagtttcgaattgctggtagcacgaaaatagtttccatccgtaatacctgctatttgagtaagggttttttcatcaatttcaaccggcgtattaatatactgtactgttcccccaaccggtaccggataaggagccataccatttgttcccacaccaatagtataaacacgtataccaaaactttttgctatttcagcagctgtcaatggagaaatatctcctttattatttgtaccatctgtcagcaaaataatcacttttgattttgctttactatctttcagcctagttactgcattagcaattcccattcccactgctgtcccatcctcaataatatcgcacttaataccttgaaatagattcagtaatacagcatgatctaccgttaaaggacactgagtaaaactttcaccggcaaaaagcgtaatacctatattatcattcggacggccattaataaattccgcagctacatctttagcagcctccaatctattaggcttcaagtcctctgccaacatactggtagatacatcgatagctaacataatatcaataccttcgatttcgctgttttgccagctattggttgtttgagggcgtgccaaaaccaagatgatcaatattagagcaatgatgcgcaaaccaaaaggtacatgcagcaaatagttcctataacttttcggtgcatgtgcatatacacgtgcatcagaaatctgaagagtcggctccgtcttcttccgcttcattatataccacacaatatatggtataagcaacagcagcaaaaacaaatattcaatattggcaaaaaccattctatttacaatttactatttcttattttatatgataaaagtaaaaacctattacgcaaacagattatagagttgtaaccctatatatacaaaggttccaataagagcagccgacaaaaatacaataccacatatcagtaatatctttgtacgcaaagatcttttctctataatggtgatttcagtaggctgtggcttcaggttctcttcttccggttgtttggtttcattaataaaatcaattgcattaattaaattcgcatcattttcgttcatttgcggatcatgcttagcgaatttaaccaaatcggctgtctggaataaatattttaaatctgatatagcttctttatcattaaattcaagcaatttatctataatttcagatgaagtcatttccaatgcattaaaaccaaatcgattcttaatatatgtgcgaagggcatctgtcaattccgtataatactccttcggttgtcccttttgccatatcttctctgtcttaatacgctctatctctttcattgccagttgatgtggaggcaacttaggctcaacctttattttacgaataataggcttattatcacggatgcgaacaatcaaataaatgagcaatcctaacagtggtaatgccaaaaaagagcaaccaatcaagccataccaatcttcccatgcaaaaggagccttcataacggtcttctgaccaaaaaactgatcaggatgcaaagtatccacaggcattgagtacactttcaatgccaatgctttcgatttatactctttattatcaatcttcacacccataggaggaatataatataaagctgaatcaaaagaagttaccgtatactcctgggtaattaacattctctggcgatcatttaaatattgtgtatcaggtttagcagtttccacaatttccaccccccgtaccagcgtatctgtaaataccggaaaaacagctttctgcttcacatccatcgctacttgtaactgcacttttgcctgttctcctattagaatttgcaaagagtctattttagcatcgacagtcacagactgtgcagcaattctgccagaaaccagaaataacaatactatcagaaatatatttttattcatctttcctgttaatttcgtttagcaaataaattcagtaacgctttcacgtaatcctgatcagtacgtaccgaaacagaatcaacattacttttggtaaacgtctcgtctaactcagtttgtttatttacccaccattcatgatgcgccttacgcactccggccgaagatgtgtctatccactgttcatgtccggtttccgcatctttaatccgcatcaaacctactgccggtaactcagctactctcctgtcatatacttgaatagcgacaacatcatgtttcctattggctatggtcattgcattcttaaagctttcctgatctataaaatcggataaaatgaaagctgtacaacgtcttttcatgacattcgtcagatattccagagcaaggcgaacatttgtacgacgactttcgggcttaaaatcaatcaattcacgaataatgtacagaatgtgtttacgccctttcttgggaggaataaatttttctattctgtctgaaaaaaaaataactccgatcttatcgttattctgaatagcagaaaatgcgagagtagctgcaatttctgttaccatatccttcttcagttgttttacggtgccaaattccaaactaccggaaacatccaccatcaacatcaccgtcagttcacgctcttcctcaaacaccttcacaaaaggtttgttaaaacgcgctgtcacattccagtcaatgtcacgtatatcatcaccaaactgatattcacgcacctcagaaaaagccatacctctacctttgaaggccgaatggtactgtcctgcaaaaatattgttcgacaatccacgcgtctttatttcaatccgacgaactttttttagaatttcacttgtttccatctatttaattgagaattgaaagttggtaattgaggattattcattctcaattaaaattaaggcacttctatcttattcaatattttacttacaatttcatcagaagttacattgctggcttccgcttcatatgtcaatccgatacgatgccggaggacatcatgtgcaacagcacgtacatcttccggaatcacatagccacgacgtttaataaatgcataagtacgtgcagccaaagccagattaatggaagcacgaggtgaaccaccgaatccaatcatatctttcagctctttcaaatcatatttttcgggataacgtgtagcaaatacgatgtctacaatatagcgttcaatcttttcatccagataaacctggcgtactactttacgggcttcaattatttcttctgccttcaaaataggtttcacattgaatttctctccattaatgttttggcgaataattaatttctcctcttcctgcttcggataatcaataatcaccttaagcataaaacggtctacctgagcttccggaagcggatatgtaccttcctgctcaatcgggttctgtgtagctaacacaaggaatggctcaggcaacaagaatgtctctttaccaatggtcacctgacgttcctgcattgcttcaagcagggcactctgcactttggcaggcgcacggtttatttcatcggccaatacaaaattagcaaaaatcggaccttttttcacttgaaaggtttcatctttctgactgtaaaccatagtacctacaacatcggcaggcaacaaatcaggcgtaaactgtatgcggctgtattttgcatcgatcaacgaagccaatgtcttgattgccaaagtttttgccaatcctggtacaccctcaagcaatacatgcccgtcagaaagtagcccgattaacagtgactctaccaaatgtttctgacccacaatgatctggtccatgcctgttgtaagattggtaacgaaagcactctgtctttcaatccgctcgttcaattcgcggatgtcaattgattcagccataaatactaattattttattgtttaatttcttacttataatataaatgaaacctatgttgtaaggctttttaatttcgattccaaaagtacactatatctttaaccattccaactaatttttattaaaaaacaatgcgaagtctttagattaaggtactttcatacgcttttgtatttgtataacataaacacggcacccagatgtatacaagtttatacacccgggtgccatacaaagccgttactttttaacaagttccggtattttaagtacagtaccatatggcacactattcggattcttaatcactccctgattatgcttaacaatataaggccacaaatcttttgtaccatagaagcgtaaagagaccttggttaaagtctccccctctttcatcgtataggtagtcttagtaccggtaattatgtagtttacagaatccggcttaacaggtattgacaccaccttcttagtaaccttttcctgagaaaccgatttactctccgatactttatccgttttcaccgacacaggtttaggattcactacctgttgtttatcctgcatttttaccaccacttcggctatagtatctgttttcataacagtatctaacgggacttcctttataggctcttttttctccaccgcttcaattacggttgattgcatttcttttttagaaaacaaatccggataataaacaaaaaccagaaccgcaccacaaagcagcataacaaccgctatgatagttaccaaataagggacaggagatttctcttttttgaatttaatttctttttgggggtgcctctcctttctcataggaacaatcggaacttctgttttctgaatctcccgagcaattatttcttctgcagtcagtttaggagcctcaccttcttctatttctttttccgccggctcttgttcttcctcgaatccctcgtcagtcttatctggtttaatgtcttccgatacttcaccaacagataatccttctatttctatgatagtctttgtgcccgtatccttgcaggtttccttttcaacttcttcaggcacatcaaccattcgacctccaatttctatattttccgtttttttcgtatcctcctcaatatcccctgtagtagtctcagcattctctgcgttttgctctggcataccctccgattctgctgtttctatctgctttgctgcctctataggctctgtttcaatctgctctttccctgaaacatcctctataaactgtgttccttctactccaggcacatccaccggatctccctccaattcctctatcggcgtatcttccaatacagtattctcattcagtacaaccgtctcaaaatgagaaaaaggcctattaataatatcccgcaaagaaggatcaggagtaaaagaaatctttgtatgtccttctatcttaattcgttcgcctgtattgatatttacactttcacggctattaacccctatcagtttaaatgttcccagccccttgattttcacgtactgatcattctccagagcctgttctatcaacagaaaaaactcccgaacaaaaacatcggcatctttttgagggaccccatgcctgctaaccagtaaatcaacaagattctgtatagtcaacctttcattcatacggaaatgcttctttaaacttatcctttaagattggacttggcttgaatgccaacaccagtttgggtggaaccaacaagcgtagtctggtgacaggattgatgacaatacgctcagccttcttttttacttcaaaagcaccaaatccctgtattcctatagcattaccttcctgcagctcctgaatgatgtcagacagcagagtagttatcaagtcagaagtatcttttgtattatatcctaacctgcgcgaaagttctgaagtaaattctttgttattcaaaatactacaattttaaaagtgtgttgctatattagtcaatccgaatgaaaaaaacaaattcttagggaaatatctttagataactttcgcaaaaagatcgaattcatcggaatcaatcacctctatttgataaaagtcaccaaccctcagactatctccctcgcactttattaatacctcaggatctacttccggagaatcaaattcagtgcgcccaacataataatcaccctctatacgatcaatgataactttcatttgccaccccaccttagatgcactaagttcagcagaaatcccctgttgaatatccatcagttcatccaagcgggcctgtttcacttcttgaggaatagaatcttcataattagctgccgcatacgtgccctcttcctctgaataagcaaaagctcccattctatcgaaacggactttacgaacaaactctttcaattcctcaaaatcctcttctgtttcacccggatgccccaccatcaacgttgtacgtaaatgaataccgggaacttctttacgaaactgttcaattaaccgaaaggtgtcttctttggtcacatgacgccgcatacgttgcaacatgttatcactaatatgttgcaatgctatatccatgtatttgcatacattatcccgttcacgcatcactctaaacaagtcttcaggaaaatgtgccgggtatgcatagtgtaaacgtatccattccacacccggaatctcagaaacacgctcaatcaattccgggagcatttgtttcttgtataaatcgactccatagtaagtcaactcctgggcaatcacctgaaactctttcacaccattggaaaccaagtatctcacttcgtccaagatctcttccatgggacgagacacatgacgtcctgtaatgattggtatagcgcaataagaacatttacggtcacacccctctgatattttcagataagcataatgtttaggggtagttagcgtacgttcaatatgaagttcgtcatggtaggcttttcccaagtcctgcaacaactctttccagttgaatttaccataaaacttatcaacctgaggaatttcaatcgccaattcttttaaatagcgttccgaaagacagcccataacaaaaagtttttccagacttccttcttctttttcctgggcaaattccagaatcatattaattgattcttctttcgcatcaccgatgaaaccgcaggtattgataactgctatttctcctgtcggtttttccgagtcatgggtaacatcatatccggcttcttccaactgacgcatcaactgctccgaatccaccaaattcttagagcaccctaatgttatgatatctatagtttttcttttcatgcattctctccaaataaggagtctacaaattctttcttgcggaaaacctgcaggtcttccataccttcacccaatccaatatatttcaccggaatcttaaactgatctgaaattccgataacaacgcctccctttgccgttccgtccagttttgttatagccatggcagtcacctctgtagccaacgtgaattgtttagcctgctcaaaggcattctgcccggttgaaccatcaagcaccagcaacacctcattcggagcatcaggtaccaccttcttcattacattcttaatcttcgtcagttcattcatcaaaccgaccttattgtgtaggcgtcctgctgtatctataatcacaacatccgcatcattagcaacggccgagcttaatgtatcaaatgcaaccgaagcgggatcagcacccattttttgttttaccaccggtacacctactctatctccccaaattacaagctgttctacagctgctgcacgaaatgtatcggccgcacccaagtaaacagatttaccggctttcttgaattgataagcaagtttaccaatggtagttgttttaccaactccattcacacccactaccataatgacataaggctttttctctaccggaacatcgaaatcagcaacatcatccgaattattctcagtcaacaatgctgcaatttcttcacgcagaattgagtttagctcttgtgtatttacatatttatcttctgccgcacgtttttcaatacgtttaatgatattaagagtagtctctactcccacatccgatgtgataagcacctcttccagattatccagcacttcatcatccaccttcgacttgccggctaccgcacgggcaatcttgctgaatacactttctttggttttagataatcctttatctaaagtttccttcttttcctttgagaaaaaactaaaaaatcccatgattacaattatttgtataatacattatgctacaaagatataataaaactggcgtaaagtaaaaattgaagcaaataaaattggcaaaaaaaatcccctcaatgaatatcagtgagaggatttttcaggttgcaatctaatgcaaccggcttatttcttaaaaaagtcttgtactttttcgttaggaaccatttgttcatcaaaaatgtaagctccagtcttcggagatttaaccattttgataaccttagtataagcacgaccttctttagatccttcgtgcaaacttgctactgttttctttgccatgggttatactctttcttttttatttaatttctttgtgtactgttactctcttcagaatcgggttgtattttttcaactcaagtctttctgtagtattctttctgttcttagttgtgatataacgagatgttcccggcataccgctatctttgtgttctgtgcattccagaatcacctgaactctattaccttttgctttctttgccataatcagtttctcctcttacgttttagccaataactttaatggttttccaatcacaataccctttggcaactgcatcattcagagcagcgtccaaaccttttttattaataatacgcaaaccagcagcgcagaggctcaggctgatccagcagtcctgttctacatagtagaactttttgttaaacaagttcaaatcaaaggttctcttagttcttctctttgagtgtgaaacattgttgccaatcatggctttctttccggtaatttgacaaatcttcgacatttctatcttatttttatagttttaatctatacttctttcaaacagagcgcaaagtaagcacttttatagatataaaacaagcatttcttaaataaattcattattcagcggtaatttttcttcatttcaccaattttcgaagtaacagaagagcattattacctgctctctccacattcatttctcttccgcggtcagtttcctgcttcatagtgcaaatttcatttttataggcagcggcaatccagactgtaccaacaggcttctctttagtacctccgccaggacctgcgatgcccgaagtggcgactgcacaatcagttttcagcgctttcatcgcaccttttaccatctcaattacggtttcctcgcttacagcacctttcttttcaagcgtttccatcgacacacccagcaatttcatctttatttcattagagtacgccactacacttcctttaaagtattccgaacttccggcaaccgaagtaacacgggctgcaatacttccaccggtgcagctttctgcggtggaaagggtcaatttcttctttttcagaagctccccaatcagaatctcaatcggtgtatcttcttcatccaaaatatcttcacctaaaatggcttccaatttggcgctctcaacatttaagcatgtctctacttcctgacgatcttgtccacgtcctgtcaatctcaaacgaatcaaaccgggtttaggcaagtaagcaagtttaatacaggacggcagcgccacctcccaaggctccagtttttcagccagcactgattccggatagttttgcacagtaaaagtacgatgtacaatggcatctgtatgaaactttgcgcacaaacgaggaatcacttcttcactcattaccgtagtcatctcctgaggaacaccgggcatggaaacaagcactttaccatccttttcaaaccaactgacagaggcacttcccacccgattattaatgaccgtacaattctctggcaccatcgcctgactcttattcaacgcattcatcggtatttttccagctaatacccgcttcacattttcaaatacagcctcactgaaaatcagtctggtaccaaaatattcacaaagggtttgtttggtgatatcatccttagtagggcccaaaccacctgtcatcaatacaatatccgcccttttcatcgaggcatccactgcttcggttatctcttctgcacgatcacgtacagacactacacgaataacttcgataccgactttatttaattcgcgtcccatccatgccgaattagtgtcagtcacctggcctatcagcaactcatcaccgatggttattatctctgcaaacatgattttttttatttagctttctcaatattatagatataaagaagaagaaagatctaccctcttttcttttataaagtcacacgtgaataagccggcaattccataggacagaagtctttatcctgatatttaaaatatcccgtaatagcgatcattgcagcattgtccgtggtatagctaaactttggaataaaaatcttccagccatacttctccgcatgctcacggaaagcattacgcaaaccgttattggcggatacaccacctgctacagctacctcgttaatcttatactgtttggctgctttacggagtttatccatcaatatatctacaacagtcgcttcaagagaagcggctaaatcagtcttatgatgttcgataaaatcgggatcttctttcatccaatcacgcaacgagtaaagaaacgatgtcttcaatccactaaaactatagtccaaccctgggatgtggggtttgctgaatgtataagctttcggattgccctgacgtgccaaacggtcaataatgggaccgcccgggtaaccaagccccatcacttttgaacatttgtcaatagcttctccggcagcatcatcaattgtctgtcccagaatctccatatcattgtatgccttcaccagtacgatttgagaattacctccggacaccaacaagcaaaggaatgggaaagtgggttgttcattctcttcacccttttctttaatgaaatgtgctaatacatgtcctgtcagatgattaacatcgatcatgggaatgtttaatgagcgggcaaaccctttcgcaaaagatactcccaccagcaacgatcccatcagtccgggacctctcgtaaaagctaccgcactcaattcctctttcgtcacccctgcacgtttcaatgcttcatgcaccacaggtactatattttgctgatgcgcacgtgatgctaattcaggtactacaccaccgtaagcttcatgcaccgcctgactggacactacattcgacaacagaaaaccatcttttattaccgcagccgacgtatcgtcacaggaagactcaattcctaatataattgtactcatacgctttttgatatttaaacgatgcaaaagtaatgataaaagtaggattcataacgaactattttatatttttgttcgcaaaataaaaacaaccgcttatcagaacgctgaagaagactgtacgctgggttatcggtattatattaggtgtatatatcggaactatcattttgctgaatattccttttattcagcgaaatatgaccacgtttgtcgcaaaagaactatcctggacattaggtactgaactgactatcggtaagatagatatcggactattgaatcgtatcatcatagacgatgtgctgctcgacgatcaatcgggcaaagagatgcttaaaattactcgtctttccgccaagtttgatattatccccctattcaacggaaaaatcgcaatcagcagtgtacaattgttcggctttaacatcaacttgaacaaacctactccgaatacggaccctaatttcaaatttgtccttgacgcatttgcctctaaagacacagtaaaaacagacaagagcttcgacttgcgtatcaactctatattgatacgccgtggtaagttggcttacgatgtactgtcggaaaaagaaactcccggaaagttcaacccccagcatgtcaaattgcataatatcattgccaacatctctctcaaagcacttcaaggcgattcgatcaatgcggccatcaaacggctaagcgtggatgaacaatcgggctttgagctgagaaagttgagcctgaaagtcatagctaatgacagaggcatgaaaatagagaattttgctatagaaatgccgggtaccgaaatgaaaatggataccattcggatggaatatgacagtttgggagcactcaatcattttgccgatgaagtccgcttctctttccgtactctgccatcctacgtgaccctgaatgatatttcagcttttgttccggcactatccaactttaaagaaaagctggatctgggcatcgatgtagaaggtacactcaaccagttgaactgcaaaacgctggaaattaatgcaggcgataaattccgactgaagggagatgtctctttacaggatctatcacgcccgcaagatgcctatgtatacgggcatcttgccaatctatctgccaataacgatggaatcggattcctggtacgcaacctgagtccgcattacaatggggttcctcctattctgcagcgtttaggaaatgcttcctttcacggtgaaatatcggggtatttcacagatttggtcatgtacggtctgtttcgtaccaacattggttctgtccaaactgacttaaagctcagttccgataaagccaaagccttgttttcttattcgggaggtgtaaagaccaccgacttcgagctgggacagttgctggataacaagcaactgggcaaaatcacctttaatctgaatgttcaaggcagccactaccgtaaccagtaccccgccatcacgctaaaaggcctgatagctgccctcgaatacagtaattataaatatgagaatatcacactcgacggagagttcgaacgtggcggcttcgacggaaaggtggcactggatgatgaaaacggttcgatacatttaaatggtaacatcaatgtagtcgagaaaatcccgactttcaacttcaatgctgtaatagataaagtacgcccgcacgacttgaacctgaccaaggattatccggacgcagaattctctctgaagctgaaagctaacttccgtggcggttccatcgatgaaatgataggtgaaatcaacatagacagtctacaattcaccgcacccgaaaagaattactttctggataatatcaacatcatagccactcgacaagacaaacaaaaccaactgaaactgacctccagtttcctgaaagcaagtattgaaggtaattatctgtatcacacacttccggcaagcgtaatgaatattatgcggcgatacattccttcattgatccagccggataagaagccgattgaaacgaataacaacttcagtttcgatgtccacatattcaatacagaactgctgtctaccgtattcgacatcccattgaagatatatacgcactcgactgtaaagggttacttcaatgaccaggcacagcggctgcgagtagagggctatttcccccggctacaatatcaaaacacgtttatcgagtccggactggtgctctgtgaaaatcctactgaccagttcaaggccaagatacggttcaataacctgaaaaaagagagtgccgtaagcatctcactggatgcgcaagcccaaaatgataccataagtgccaacatcaattggggcaataataccatcaacacttatagcggacgattatccgctgctgccagcttcttccgcaaggccgaagaaaagtcggcactgaaaacagtcgtagacattaagcagacagacattatcctgaacgacactttgtggcagattcatccgtcacaagtagtagtagattcgggcaaagtagatgtaaacgatttctatttctcgcataaagaccgtcacatccgcattgacggatgcatctcggaacatgccgaagatacactgaaggtagacctgaaggacatcaatgtgggttacgtattcgatgtggtagattttgacgatgtggactttaaaggagatgccaccggaacggcatatgccagtggcattttgaaggagccggtcatgaatacccgcttacattttaaaaacttcactttcaatgatgcttctttgggagcaatggatatttacggagcatgggagaacgacaaacgtgccatcttcctggatgctcacatggaagaagaagggctatcgaaaacgcacgtcatcgggcacgtctatccgttaaagccggaaagtaaactggatttgaatatagaaacggagcatacaaacattcagttcctccaatatttcatgcgctccattgtcgaagacctgcatggacgtaccagtggcaaagctcatttctatggaaaattcaaggagctcaacatcgaaggggatctgatgacagatgcgtcgttgaagataggaatattaaacacatcatttgccgtaaaagacactatccgtctgtccaccaccggtatcactttcgacaatatacatatcgcagatatggaagggcaccagggcacaatgaacggcaaactgaatttcaggcatttcagggatttgagctatcacttcgaattcaacgtgaacaacatgttactgatggacacgaaagaaagttctgatatcaacttctacggaaaagtgtatggaaccggcaatgcgatgctggttggcaatccgcaggaactgcaagtcaatgcagccgtcacgaccaaccgcaataccaattttgtctacataaccaatgccactgcttcagcagccagcaaccagttcattaagtttattgacaaaactccgcgcagattcgttcaggattccatcaatgtaatatcagaatatgagcggctgcagcaggagatggaggaggaagagacaaaaacggatatccgtctgaatctgttgatagatgctactccggacgctactatgaaaattatcatggaccccattgccggagactacatcagcggtaagggctccggcaacatacggacagagttctttaataaaggagatgtgaaaatgttcggaaactaccgcatcagccagggtatttataagttcagcttgcaggaagtcatccgcaaggactttatcataaaagacggaagcagtatcactttcaacggtcccccgttggatgcgacgctcgatatacaagccagttatacggtgaactctgcttcgctgaatgacctgatccccgatgccgcagacccgatcacccagcaacccaatgtaaaggtgaattgcatcatgaacctgaccggaattctctggcgccccaatattaaattaggtatcgaactccccaacgaacgggacgagatacagacgctggtacgcaattacatcagtacggaagagcagatgaacatacagatactctatctgctgggtatcggcaagttctatccacaggagagtaccggaggcacccaaaactccaatatgacatcgtcagccctattctctaccctgtccggacagttaaacaatctgttatcgcaggtattcgataacaacaactggaatatcggaacgaatctcagtaccggtgacaaaggctggacggacatggaaatagaaggtatcctgtccggacagttattgaacaaccgtctgattattaatggtaatttcggctaccgggataatccgttagctaataccaatttcatcggagactttgaagcggaatggctgctcaaccgctcaggagacatacgtctgaaggcgtataatgaaacgaacgaccgttattatacacgaaccaacctgactacccaaggaatcggtatcatgtacaaaaaagattttaataaatggagtgaacttctcttctggaataaatggaagttgagaaacctaagaaagaaacaggctaccgcacgagacagcatcccgaatgacacggtaaaggacatcaccaaagctaaatcggaaatgaaaagagagcatccgatgtgacgctctcttttcttcagtctttattttcgtatgtctctcttacaaagaaagaatacaaaaacggaaagtgtatgaataccgataaagggatgtgaagaagatagaacgattaaaagcccttatcgacaataacctttccgaagggagtcagagccagtccggcaagtttgaagtgttgtctcccgaatggtataccaatgattgtgatacaaagcagaattccccatcccagatgagagaggctgatccaaattccaccgagaaacagccagactatattcattatgatactgaggcaacctcccgaatcgggggtgctcctcacctctttgccgaacggccataaagcaagcccggccagtttcagagtctgaaagccaaatggaataccaataatggtaaccatcatcaagagacttgcaataagatactctatcgcagtaaaaatgccgccacacagcagccagataagattcaagaatggattcataggctattagaataacggtagtaaagaaaaaggtcggaagttcatttcggtacctccaaccttttttccttataccttatattaattattaataagaacgagcaaatatcacacggcaagcagaaggtttgccggttaccatacacttaccgggctctttgtcaccttcaacaaacgaatcgaacgggatacaacgaatagtagcttttgtctcttccttgatcttctcttctgtttccgtagttccgtcccaatgagccagaatgaaaccgccctcttcgattttttccttgaattcatcgtagctgtctaccttagtgatacgtgaatcgcgataagtacgcgctttcttgtagatgttggcctgaatctcttccaacagattttgaacatatgtctcgataccatcgcaagtgacggtctctttctccaatgtatcgcgacgcatcacctccatcgtattgttttccaggtcgcgtccgcccattaccagacgaaccggtacacccttcagttcataatcggcaaatttgaagcccggtcgtttgttatcggcattatcatatttgaccgaaatgcccaatgccttcagcttcgctacaataccttctaccttggtatcaatctgtttcagctgctcgtcattcttatatataggaacgatcactacctgaatcggagccagatgcggaggtaataccagaccgttgtcatccgagtgggtcatgatcaatgcacccatcagacgggtagaaacaccccatgaagtagcccatacgtactcaagcttattttctttattaacaaactgcacatcaaacgctttcgcgaagttctgtcccaggaagtgagacgtaccactctgtaacgccttgccgtcctgcatcatcgcttcaatggtataggtgtcgagcgcaccggcaaaacgttcattggccgacttcacccctttcaccaccggaaccgccatgtatttctctgcaaagtcagcatatacattcagcatgcggattgcttcttcttctgcctcctcacgtgttgcatgtgccgtatggccttcctgccacaggaattctgctgtacggagaaacagtcgtgtacgcatctcccaacggaaaacgtttgcccactggttgcataagataggcaggtcacgataagactgaatccagtttttataagtattccagatgattgtttcggaagtcggacggataatcagttcttcttccaactttgcagcagggtcaaccaccacacccgaaccatcttcggcattcttcaggcggtagtgagtaactacggcacactctttggcaaagccttccacatgctcagcttcacgactcaagaatgattttggaatcagcaacgggaaataagcattcacatgtccggtttccttaaacatatcgtccagctgacgttgcattttctcccaaatagcgtatccgtaaggcttaatcaccatacatccgcgtacagccgattgctctgccaaatcggctttcactaccaaatcattataccactgcgaatagttttcgctgcgtttggtcaggtctttcagttcttttgccattatatttttcttcttttaaagttttctatcttcaaaacaggatgcaaaaatactaaaaatgggtgaactgtgatcattctttatctataattttaagagggaacccggcagaccagttcataaacaagccggtttatcgattgacaaccggcttatttatgatttttcagaaagcagaatcaccacttcttgcctttttcttccaacggaagtccgtcgctgaatcccatggaagcatgtgtaccgtcgcaaaacggtttattggacgactgtccgcaacggcacaaagtcaccctgttcctgactgtatagcttttgccatccgcactctctatgcggataccgccttttacccaaataggtccgctcactctgattccaggatcctcaataataccgatagagggctcaaaaggcggttcgaagactttttgcgtctctttgtcccaaacgacgagccgcccggcaggacaatggccggcctcgcgacggacaagttcacgctcttcttccgtttcagcgagttgtaccagattccagattcggccgcgtgcatcgcagaaacgggcaaaagcacaatacttttcgttatcggcaagcaccatggcggggccttccaattcctcggcttcttcaagtaacggacgtttgttattggtttcattagagtcccaatcggtggcacgcttatgagaaccgtcacagaagggtttatggcgggaatgcccgcaacggcacagagctaccggagtggccgaactgtcgaaactcagcccgcgttgatacacccacgaagaaccttcttcattgggaagaataatttcctggtcaatgggaggattaccataaacaagataagggccgtcaggagttattttgatataatacttctcgggtgcttgccgactgccctcttctactaaaatttcttctttcttagtcataattttacgccataaggaggtttaacatatcctttatcgcttaaagaacagatagtcaagctaaaaagtttcttataacaccgtctaacttcttacggattcgttgataccaaacccgaaaagtgcaaagtctcccttcaccggatcatccggccatatctcccgcaatgcatcggtaatacaacgcgcagtcttcagacatttacgtgcatcggtcagtccaagatcgactgaaatgcgatgcacatgcgtgtcgagaggaataatcagatccgaaggatcaaaactccgccagatacccagatccacaggagaatcccgacgaatcatccagcgcaggaacatacacatctttttcgcttcggaagcacttgccaaagcaggcatcccattgatatgtccgaacacggattgcagtctttccaacggagtaccccaagaaagcgaatggcacaaatgcgactccaggtcttcatgttcctgataggccgcatacaaagcctgacaaagtaaatagaaatcattccaggaataataacgatagaagctggtttttactcctcgatatttcttccactcctcactaagtatataccggtaaggagcattcgagaacagttcacggtcaatccggtcgccgcttttgataatagccttccggtttccggtagcaatccaagaggctaccagggcagagatctcaatatcggccttgccggtatagcgatgtggaaactgtacagggtcatccataataaattcggctacctcgtatttatctgccaaaaatgcaagtttattctttagttcttgtttcataaacgttagaaggtatgtatcaaaaagaaacaccacagattacgcggttctatacatgactctgataatgagtctgtaaaagtacgtggaatctgtggtgaaaacctcttactgcaatctcagtaagttttttatttactaaaatctctcggagcaggtaccggagccaatggtttacggtcttgaagctgtttcataacctcttcgatggctctgttcagctgttgatcctctccattccactctttcaccggatcattatcgatcaggatatccgggtccacaccatggttttcgataatccattgtcccgtcttcgggtcataactggtaaagaacggaacacgtatgtctgttccatccatatatggcaatgaaccactaatgccaacaatacctccccaggtacgcgtacctatcaacttgcccaatccaagtgcgcggaagccccacgggaacaggtcgccatcagaagcggagtatttattaatcaaacaaaccttcggtcccacctgtacagcatcaggcactgttcccacatggctggtacctctacccatagtcaggcgataaggttcacgggaaagacgttccaggatcattggtgaaacattacctccaccattggcacgatcatcaataatcaacccttctttatcaagttgcggatagaaatagcgggcaaactcgttcaagccttccggtcccatatccggaatataaatatatccgatacgtccgttggaagcctggtccactttctttatattatcctgtacccaattgtaatgtatcaaaggatattcattggcaagcggactgatcacaaccttacgtgctccggaaagctgaggtttggcattcaacgaaatttcagtaggtatctctgctttacccaccagtaaagaatacatatctttaactgtattggtcggcacaccatcaatagctacgatgtactctcctgctttcacatcaacccccggttccgtaagcggagagcgcagttctttgctccaagatgctccggggaatatcttctccagacggaaaaagccactcttgtcgcgggtaatctccgcaccaagcaaaccggtattgatccgtttgggctgttccgtttctcccggattgacataagcatgcccacagttcaattcacctatcatctcaccgataatgtaattcaggtctaaacgagttttaacgtaaggcagcaagaccgcatatttttctttaattgctttccaatctacaccgtgcatgctctcctgatagaatccgtcacgataggcacgccaagcttcatcaaagatttgtgcccactctttcggataatccacagtaatcttcatattgcttaaattgaccggagtggtcagttctgtcttacccgaaggaagattggtcacataaatctgacggcctttaaagaaaagtgccttcttaccatcgtaagtaacatccatcgaagctccatcggcaatcgattcctctttctgacttgccaagtcatacattttcgtaccaccgcgtccccagtagtacaccttgttgccatccgaatagaagttaccataataagacggagacaagggcaatcgaacaatgcgatcggtaatgccatccggatcgaacttcaccaacgaagcatcagccacttcctttttatctgccggtttcttatccccgctttggggtgtagcattagatgcagccacttccgcatctttctgcatgaaaggagacgatgtatctttagacagcaaagcgatgtacacaccatacatattattatatacatggttccattccaatgatccgtaagtcggattaaaatcacgggcagaagagaatatcagatactttccgtcggcactgaacaccggagaagaagagttataccatttgtcggtcaccggatattctttcttttccgcaatattgtagacatatacgacattgatttcatttttacccatccgtgtataagtcaaccactcactgtccggagagaaagtaactccacccggcactcccatcggatcttgcaataataatgaaactttcccggaagccacatccagcagattaactcggttcttacgatccatatacactatcttcttagaatccggactccatttaaagccacggatatatgtatcgttcttatgggttaactgcatcggttcgccacctgccgcattctgcagataaagttcggtttcgcctgtagcatcagagatataggcaatctgtgttccgtccggtgaccactgtgcgtcacggtcgtgagctcccggcgaacgagttatattttttgtaacccctttctctaccggcagattgaatacttcaccccggcttgtcactaccattcgtgctccatccggcgacagactggccgcagtcacataattcgctccgtctttcaaatcggtacgggcatagatgttatccgaagccagtgtaatgtttaccttttcagccttccgggtagcggcatccatcttataaatatatccaccattctcaaagacaatggtatttccactggcacttgggaacttcacatcatactcagtgaaatcagttaccttggcagtctgtttagtcttcgtattgtatacaaagatattcatgatgcggtcacgatcggaaaggaaaaagatttcatcgccaatccacatcggaaaaatgtcctgagctacattattggtaatgttttccactgttttgctgttcggattatacacccagatatcatccgccataccgcctttataatacttccaggtacggaattcacgcatcacccggttgtatgccaactgttttccgtccggtgagtaactacaaaatccgccctccggaagaggaattgcttctgacaatccgccttccttgtccactgtaaacagtttgccggaaaatccatcactgatacggttacggtatacgatgcgctgtccgtccggtgtccaggtcatgacaatgttattgggtcccatacggtcacccaggtcatcgcggctattggtagccgtataggtaactcgtaacggttcaccccctgtcgcaggcatggtatacacttctgtatttccatcatactgtccggtgaatgcaatcgttttgccgtccggagaaaaccggggaaacatttcgtaccccacatgggaagtcagacgctgtgcctcacctcccgcagcaggcactttatacaaatcgcccgcatacgaaaatacgatctcctttccgttcgtagcaggaaaacgcagtaatcgtgcttctcccgcagccgataacagtacaggagcccctgccagaacgaagatagataagattagtttcttattcatgtgattatctattaaaattgattcacaaaggtaagaaaagaacaaagagtgaaagaggaaatacacaaaaaaaccgcagattccatcattcttttctcacaaaaagatcaagggaacctgcgatatttacttttgacttgaaaacatgaattgagcggtaggcgagggtcgaactcgtgacctgcggcttgggaagccgccgctctgccaactgagctactaccgcaatataattgcttccgttttgtaaagcagtgcaaagataaatattgtttctgaaatacccatggcaatggcacaatattttgcatccgggaacggaaatataaaatattaccgtacatttgctaaccgaaaatacacagatagattcatgaaacagatcatacttatcaccggaggggcacgttcgggcaaaagcagctatgccgaacggttagcattatctctctcccccaatccggtctacctggccacctcacgcatctgggacgaagagttccgtcaacgggtgttacgtcatcaggccaaccggggaccggaatggaccaacatagaagaagaaaaggaactgagccgccattctttgcaagggcgtgtagtgctgatcgattgcgtaacactctggtgtaccaattacttcttcgaccttgaagcggatacagacaaggcactcgccgccataaaaaccgagtttgaccggctgacagaacaggaagccacctttatcttcgtcaccaacgagatcggcatgggaggcacctcagaaaaccttatacaacgaaagttcaccgatatgcaggggtggatgaaccagtatattgccacccgggccaatcaggtcttattaatggtatcgggcattcccgtgaaagtaaaagatgaaaaacaaacgatagactaaccctatataaaatgaaaacatttcaaatcaccagaccggacgaaacaatccgggaagcattgactgacaaaataaacaatctgaccaagcccaaaggttctctgggaacacttgaagaactggctttgcaaatcgggcttatccagcagacactgactcccacgctgaaatgtccgcagaacattatatttgcagccgatcatggcattgtcgacgaaggtgtcagcctctctcccaaagagatcacctggcagcaaatcagcaacttccttcatggaggggcaggtgtcaacttcctctgccgccaacacggattcgaattaaagatcgtggatgccggagtggattacgatctgccttacgacaagggaattatcaatatgaaagtacgcaaaagttcacgcaactacctgcatgaagcggccatgacggaagaagagatggacttgtgtatagaccgcggggcagagatagtccgccggtgccacgccgaaggatgcaatgtgctctccttgggtgaaatgggaatcggcaacacttcatcctcctctatgtggatgacctgcttcacccgtattcccctcgaacaatgcgtcggcgccggaagcggactcgacaatgccggaatccgtcataaatacagcgtattgcagcgggcactggacaattatcagggagacggaagcgtacgcgacctgattcgttacttcggcggcctggaaatggtaatggcggtaggtgccatgcttcaggcagccgaactgaaaatgattatcctggtggacggattcatcatgacaaactgcatcctcgcggcatcccggctttaccctgaagtaatgcactacgccatcttcggccatcagggagacgagactggacacaagcttctgcttgatgccatgggagccaagccgttattgaatctgggtttgcgccttggagaagggaccggagccatctgctcctatcctatcgtagactctgcggtgcggatgatcaacgaaatggacaactttgcgcatgcgtccatcaccaaatacttttaaagaagccccacatgaatatattagcagcatttatctttttcacccgtctccccttctggcgcatccgggaagttccggcagaatgttttaagcacgtggtgccttactggcccctttcaggatggcttacgggcggcgtcatggcgggggtactctggtcggccgcacaggtcctccccttcaccgttgccgtattgctggcacttaccagccgattgttgattacaggcgcattgcacgaagacgggctggcggatttctttgacggattcggcggaggcaccagccgggaacgtatcctctctattatgaaggattcgcacatcggcagttatggggtcatcggattgatcgtatacttcttcctgctatggaatctcctgacaagtcttcctctctccttcgcctgctctgtactgattgcaggcgacactgtgagcaagttgacttcatcacagatcattaacttcctgccttacgcacggaaagaagaagagagcaaggcgaaggtggtttataatagaatgtcgcaaggagaatttgctttcggacttttatgcggaatacttcctttgacgctcctgctcccgtacaggtactggattgccattatattcccactggcagtgttgtatctattatacaggctgatgaaacgaaagttacaagggtatacaggcgattgctgcggtgcactgttccttttaagcgaactgtccttctacctgggggtagttattcttatattcatatagtttgactcaccacagagtaacacagagttccactgagatgatttatctcttaaacatcttatagacaataatttaaaaaccggtgatactctgtgttactctgtggtgaatcaaactcatacttaaaccaataagatcatggaaatcatattgatccgacatacctctgtcgatgttcccagaggcgtctgttatggccagaccgatgttcccttacgggatagttttaaagaagaagccacaatcacggctcaacagttgcaggatgatgtgtttgatgccgtattcacaagtcctttgagccgctgcacccgtctggcagagcactgtggctatccggatgccatccgtgatgcccgtctgaaagaactggacttcggtgaatgggaaatgaaggagttcgacaaaatagatgatccgcgactgcaagagtggtatgacgactatttccatgtagcagccacaggcggagaatcgtttatgatgcaacttcaacgggtctccgaatttctggatgaagtgagcaggcaaaagtacgggcgcgtggctgtcttcgcacatggcggagtactgatttgtgcacagatctatgcaggaacattaaagatggaagatgctttcggcgcactgacaccttacggtggaatagtccggctgcaacttaacccaaagacagcagaacagtcagccacaccaacgcgaccatcaacgtctctgccttctgattgacggataccgctttcctcatatccgctgttgtcaatacccgttcgttatcaccgatgaacggtttccatacctcctccccgaagtaataatgcggaccgccgaaccggcaattcaggatacctgccaatgccgcctccggataaccggagttgggactggcatggcgactgccgtatttacccacaaacctgaataaagaaagccgtccgctgacgattatcatcaacagagccgtcaggcgggcaggaatgtaattggcgacatcatctatccgggccgctatacagccgaactgacgatagcgctcgtttcggtaaccaatcatcgagtcgagcgtgttcaccatcttatacgccatcatgccgggtactcccagcacagcataccagaaaaggggtgcaatcactccgtcactcagattttccgccaaggtttccaaagctgccgtgcgcacttcctgcgcagataaagcagaagtatcccgccccacgatacgccccacctgtcggcgtccctcgtccaacgaacggtccaccgcctcgaaaaccatccggacctcacgtatcaacgtcgttccggccaggcagcagaatatcagcagggtctttatcagagccgtcaatacgatggaatactcttcggtcaccctgagaaagaagcaagtgaaaagatagactcccgcaatcagcactgccgataccagcccacctttccaaacgcgggcactccccacattcatcgacttttctccccaagctatcagtttgccgaatcccaccacaggatgcggcaaccaggcagggtctcccaaccagcgatccagcagccaagccaaaggcaagggggacagccggcagaaatatacaaggcaaacaaacccaaaaaacatctcgtccatactctgatacatccttaatctgtcattattccgccatccactccgcaatggccctcaccagttcatcattctcttccggtgtctgggtggcaactcggaagaaacgttcgtccagcccttcgaagttggaagcatcacgaatcagaattccttcttcacgggccagatactctttcaaggcggcagctttaccgaatcgcaaacaaaccagcataaagtgcgtatcggtaggccatacttccagtccgcctatcgcttcaagcgaacttttcagacgggcacactctgccagatagtccttcatggagagagcttccggaatgccctcggaaagcaggtagagacctgcctcgatggcaagctgattgaccgaccaaggcatgcggttcgtacgcagacgagccatcagccccggctgcgcagttacgtatcccagacggagccccggtatggcatatcgcttggtcatggaatgcaagaggatcacattgggaaatccggcagcttcacgtgcggtgaagagttcctccaacgtaaagtattcatacgactgatcgatcacgaagcaaacctgcggatgtttcctgatcagttcggtcaggcgctccttaccatgcacctctcctgtcggattattcgggttgcagagccataccatacgcacgtcctccggcactgcctccagcgtatacagggatgtgaccctatgcccgtgcatgcggcaggcatcggcatattcgctgaacgtaggcatcagaatggccgtattcgtcccccggaaggtttgcgctatcagataaatggcttctgtggcaccattcgtcacgcaaaccgaagcggcaggcaaagcgtgacggtcggccagacgggcctctaatgtataaggttccggttcggggtaagcggaaatggcggagatacgcccgcacaaatgcgtccgcagcccgtcaaggtttaccttattatatacgttcgaactgaaattactccgtatcgggtggaggtatttataagaatcgtctccgtgtccttcaatcattgtctgtcaatatttgatagataagcggcaggtcgacatgcttgcggacgtggactgccagtttatcgtattgttcttctttaaacgctttatagtcgaaagtggtctccttcagcttatcggcgaaaggttccagcagatagtcgatgaccgaaggattgtcgagaatgccatgtacgtatgtccccatacaggtacggtcggcaagatatccgtcctcccttccgtctgccagatggttgagtggcgaagcgggaacatcggcaaggggcgtcgttgtgcccatgtgtatctcgtatccttcacaggtctcgctgccttcaagaaaatgaaaacgtacctgccgcgtaatcttttccccctgcatacgagtgctgacgggcaataatcccaatcccggcaagcgttctatctcaccttccacatgatcgggatcgcaaacctcctgccccatcaactggtaacctccacaaatgcccattaccgtggcaccttcgcggtgggcacggacgatggcctgcgccactccgttgcggcgcaactcatacagatcggacaaagtgcttttcgaaccgggcaacaggatgatatccgctttcatcaactcgtccgtattgttggtgtagaacaggtgtacacgcggatcgcgctccaatacattgaagtcggtaaagttacttaaatgccggagcagcactacggccacattcactttgccttgtccggcacggatattcttggtctgaagcatcaccgagtcttcttcctcaatatagatatctttatagtagggcaccaccccaaccaccggaacaccacagagatcttccagcatctttacccccgactcgaaaagacggatatctccacggaatttattaatcaatatccccttgatatgtttccgttcttcgggccgaagcagcatcaccgaaccataaacactggcaaacactcccccacggtctatatccgccacgagaatcacatctgctccggcatgcatagccataggcagattcaccaaatcgctgtcacgaagattgatctcggagatgctccccgccccctccatcactaccggattatatcgggcagccaaacggtcgaatgcggcatgaacctcttttcgcaattcctcccgtccttcacggcggaaatattcgtaagcattccggttaccgatggggcgcccgttgagcaccacctgtgaagtatgatcggacgatggtttcagtagcaacgggttcatatccgtatggcaaggcacgcctgcggcctcggcctgcacagcttgtgcccttcctatttcaagtccctcgggagtggcatatgaatttaatgccatgttctgtgccttgaatggtgcaggatgataaccgtcttgcaggaatatgcggcaaaaagcggcggcaatgatgcttttacccacatcactaccggttccggccaacattaaagggtgtaagttcttattcatatcgtgtttgtcacgttaatgggcgacaaacttagtgaaaatattcgggggggacaagtagtatatcaatgactttttgatagattctcccatatatgcacccaaggtaatggaaagtggaaccatgcttagtccctcgtagctgctgacgcgatagcccactgctatgattacatccaagttatacatcggagcacacccgtttcatcccattggtccgatggaattctaatttttcgaactgcttcggacaaatggatttcgccactctcatcaatctgcttcaagtggtagttgatagtcgaaaccgtagtgccatagttctgccatcctcttttgcgataaccagaaggtatcgtgattaaaaagcaccgtagcattcactttgcctactcctgagcggtaaatcaagacattcgactccataccttttacaagttctgaagctgaaagccgaccaccgaaatattcaatgcccggctgtttcatgggcttacgcttatcagcattggttgcaatagtcaagcaaatagctcatcaatatcatgcctttttcttccatataaaataaccaatgcatagggccgtatgaaggaagcgatatacccatacaaaatgcctgatacatttactgtaatatatccaaactcaactttcttgtcacattctttgctatccccacaagattctttatctttgtcacttgaaagccaaagagaaatacagctcattgaaacaattttgcagacgaagaaagtcccaaattaatttaatgcaaaaactgaatatcaatgaatctgtttcatacgtacgacgtagggtcgggcatgtgaacatatttattatatacaggggtattggtactacctttcgtctggataaatatgaactcagcgtccgacctcttatgtataccttatacataagaagtcgagcgttcataataatgacaggccaatcaaaaaggtagtcgagcgtttgaacatatttattaagttcaaaggtattggtagtacctttcatccgataaatatgaactcagcactcgacttcttatatataaaggtatacatcaagatataagcgtttataataatcagaaaagcataaacagaccttattgactagcaacctgcctcactgaggtatgtccttcccaaactttcttgtcacattctttgctattcccacaagattctttatctttgtcacttgaaagccgaagagaaatgcggcatattgaaacgttttttgcggaaagaaaagtaccaaatttaattaatgcataaaaacaagaacttcaataaatcagtttcatacgtgcgacgtagggtcgggcgtgtgaacatatttatgaagttctaggtattggtactacctctttccgcgtaaatatgaactcagcgcccgacttcttatatattaaggtatacataaggatgtggacgttcataataatcagaaaggtatgaacagaccaatcaaagaagtaacaaggaggggcaggcatggctaactggataaccctcaaacaactgtcggagaaacgcggtattgccgaatccgacctccgcacatgggcaaacttgggatatatcgcttcatcgaggatagagaacgtcctaatgattgatgacgaaagcctgacccaatatcttgatgttcaccagaccaaagatttaggtgagaattatctggaaaagatcatcaaagaaaaggaactggaacgtgaagtactcctctcacaatgtgacgacgaactatttctattgaaaacccagaaactacaccaaccgcttttccatatcctcattcaggaactcggtcagttgattacggacgatcacgaacgggaaatattcctttccgtctccagtggcgaacccatcgcacgggtggcgaaacgtaacaaaatgacgtatgcacgagtggcgactaactatagttccatcctccggactctgggcgaacataaggggcgaatcgccacatttcgcagtcggacgatggaactgatgttcgataaatgcaatacggtcacacccgtaaatactcccctatcaaaccttgtcggcgcgcatgcctataatgttttatatggagagatgggattcaggacagtacgcgaccttctgcaatacaccacccagaacggatggcaaagcctgagacgcttcaagggcatggggctggttacgtataagagtgtgatgaacgcactaagggatgccaacttcatcattgtccgcaaagacggaaacatcgagctgtcaccagagatcgctgcgctggtaatataaaaaagatagaaccgagtatcccgaagggaattgagccagacacaaagtacccttttatcaaaatgataatccaaacgcttcagattcgctttttcccgtacaaagtaccaaggatgggcaaaaatcgccgtattttcgcatcaagagaataccgttggaaaccaatacatcaattacgagaacaaaaggatacctattttgcattatcgtttaacaacagaaacaaaaaccaataaaatatcatattcttatcaatcatcaacctatcactctacgaaagcaaccagagaaataggaccactgttttcactcccaaacaagaacaatatatgtaatggaagaaaacatatagagatattgggcaaaactcttattcatttttgaaaaacgcaaccgtctttcggagcaaatgcttacttcttttagtcgaaatgccggctcttcaaagtgaaaacgccggctcttcctcctcccaagcccggctttccgagcgaagaagcggaaagttccgagacattctctcctatatgggcaagaagatgaaaagggatagttagcggaaaaggccattagccgtctttttgattccgaaaacgttttatagatatcaattaggcaaatgaaattaattctgaacggaaccttattcgctatcaattaatttattatctttgtattcatactaaaaaaacaagacgcattatgaaggagtctaaaaaatacaagcaacaagaagaggaaacaaccaaagtatccgaaccggtagtagcttacaatagtatggcttatcttgaattggaagcagaaaaagcagaattgatccggactattgccaatatagacagcaaagagatcatcgacaaagtgaagcagaaacttcacgatgtgctcggtttgagagagaaaactgctgttaagaaagcagctccctgccagctcacagaagatgaaattaaagaagaaatagaacaagcaatagatgaaatacaacaaggacaaatcatcagcagccaagaaatgcacactacttttaaacactatctattatgatgaagatagcatggacaattcaagcacaaagaagggttattgaaattttagaatacagccaacaagagtttggtaacaaagcaaccgatcgcctggcaagaaccattgaacaaaaaacattgcaactaatcaataacccattccgaggacctgtagaactgatacttgccaaagagaaaaagattagctgccgatacttactcgtaaatccttataaaattatatattatgtagatgaaaaggaagaaagcatatacatcgtaactttgttccatactcaccaacatccttcaaagttggacaaagaaatcgaattataaagacggcattcacttacattttctgaacaaacctcccccctcgtctgttacaaggactcataaacctaaaccgtaacagacgtatggaaaaaaagaaaataccggtcgcgctgatgatagcggcaggaatactcttatacagcaacaccgttctggcgcaaagcctccctcccacgcgggaaacttcgcagcagcaactcagctttgatgaagcgttgcaactgctgcacaagggcaaccaaagcctcaagatagccgacaaaggtatcgacatagcccgtgccgaacggggaaagctcaatgccttctggatgcccagcctgcaatcgacgggcgcatttgtgcacctttccgaaaagatcgaagtgaaacaacccctttcccagttcaccgatccggccaaagactttgtacataccatcctgccggatgataagatcatatcgtccatactcgaccagattggcacgaacacacttattttcccgttggcgccgcgtaacctgaccactgtagacctcaccgccgaatgggtgctctttgccggaggcaaacgtattcatgccaccaagataggcaacacaatgatagacctcgcccgtgaaaaccgggcacaggtagacgccacgcagcgcacgctgcttgccgaaagctattacggcctgcgcctggcgcaggaagtcgtcagtgtccgccgggaatcgtaccaggcactgaagctccattacgagaatgcgttaaagctggaggccaccggcatgatagacaaggcggcacgcctctttgcccaagtcaacatggacgaggcactgcgcgagctggaagccgcccgcaaggaagaggccgtggtgcaacgtacgttgaaaaccctgctcaatctggaaacaagcggagacatcacaccttcctctcccctgtttatcaacgataccctacctcccaagatggagtttttgcaggtggtaggcatcagcaactacctgctcaaccaactgaaccttcaggaacacatggccaagcaacaggtccggatagaccagagcggctatctgcccaatatcgccctcttcggtaagcagacgctttactctcatggcatacaaagcaatctgctgcctcgcaccatggtcggcataggtttcacctggaaccttttcgacggactggaacgggagaagcggatccggcaatcgcgcctgacccaacagactctcgcattggggcaggagaaagcacgtgacgatctttccgtcggagtggacaaactgtacaccggtctgcaaaaggcactcgataacgtgcgagcactgaacactaccatcgagttgagcgaagaattggtgcggatgcggaaaaaagccttcgccgagggaatggcaacttcaacagaagtagtagacgcagaaactctgctatcgaaaacaaaggtggccagactggcagcctactacgagtatgacgtaaccctgatgaatctgctggcactctgcggcataccggaacaatactcgaacctgcaaaataatcaataaaacaataataaagagatggagaagtcagaatctaaaaaaggcagaaccttaagcatcgccttcatcgccgtacttgtggcagtagccttgttcactgccatcggaatgattgccatgcgccgccagcccctgatcctgcaaggtcaggccgaagcaaccgaaatccgtatcagcggcaaactgccgggacgcatcgacaccttcctggtggacgaaggcgagtgggtgaaacagggtgatacgctggtggtcatcaacagtcccaccgtagaggcgaaataccgccaggtggacgcattaaagcaagtggctgtagagcaaaacaagaagatagatgccggaacccgccggcaaatcatagctacggcgcagcaactgtggaacaaaacccagagtgacctggcactggcacggacaacgtataaccgcatcctcaccttatacaaggacagcgtggtcacctctcaacgcaaggacgaggtagaagccatgtataaagcggctcaggcagccgagcgtgcggcctacgaacaataccagatggcagtggacggggcgcagagtgaagataaagcttcggcccgctccatggtaaacgcggccaacagcacggtcgatgaagtttcatcactgctggtggatgcccgcctgattgcgccggaagacgggcagatagcaacgatcttcccaaaacggggcgaacttgtggcaccgggcactccgatcatgaatttggtagtgatggacgacgtgcatgtcgttctcaatgtaagggaggacctgatgccaaacttccgcatgggaggtacattcattggagacgtgccggccctcgccgaaaagggaatcgagtttaaaatctactatatcagtccgctggggagttttgccacttggaagtcgaccaaacaaacaggaagctacgacttacggactttcgagatccacgcccgccctacccggaaagtggaagggttgcgtccggggatgtcggtattggtggagatcaaatagagaatagaaatgaatacgattcaccacagaggacacagagggcacagagtttaaattttctgtttatagaatattaaagagaaatatatattttctctgtccctctgtgtcctctgtggtgaatcaaactcaaaaaccaatcattatgcaacaatcccctatcacccgtgtcgtacaacgtgagtggcgacggatgacctcacggcgcctttacttcggcgtctgcctggtgcttccgctattcacgcttttcttcatggctaccatattcggcaacggacagatggagaacatccccatcggcattgtcgaccaggacaatacggccacctcgagggatattacccggcggatgtctgccgtacccaccttccgggtggttcgtcacttcgtcgacgaagccgaagcacgcaaagcggtacagcagaaagaaatatatggttacctttccattcctccacgctttgagcaagatatgatatcgggacaggacgctacgctgaattattattatcactatgcactgctctcggtgggaggcgagctgatggccgccttcgaaagctcgcttgctcccgtagccctctcacctatcgtgatgaaggccgtggcactgggcgtaaacgaacagcagatagaaaccttcctgctccccgtacaagccaacaatcacccgatttacaatccatcgctggactactcggtctacttgagccagcccttctttttcgtactcttccaggtgctggtactgcttatcacggtatatgccgtagggagcgagatcaagttccgtacggccggcgaatggttacaggcagccgggggtgacatcacgatagccgttatcggcaagttgctgccttatacacttattttcagcctgatcggcatactgggcaactttgtcatgttcggcatcctgcacataccttttcaagggagctggttgctactcaatggaatgacggtacttttcattatcgccacccaggcactggctctgttcatcttctccctgtttcctgccgtggcaatcatcatcagtatcgtatccatggtcggatcgctgggggctaccttgtccggcgtcaccttcccggtactcaacatgtatccgttggtgcgagacgcctcttatctgttccccgtgcgccattacaccgagattacacaaaccatgctctactatggtggcggattcatccacctatggccttcggcagtgatactttgtatcttcccgctattggcattggcgatgctcccccacctcagacgggccataatcagtcgtaaatatgaaaatatccggtaaactatcgcagatttccttcatcatcacacgtgaattccgtgccatcagcaccagttatgccgtactgttggtgctgatgggaggtatctttgtttatgggctgctctataattatatgtatgctcccaacatcgtgaccgacgctcccgtagcagttgtcgacaactcgcacagcagccttagccgccaatacatccgttggctggacaccacgccgcaagtagccgtctatgcacaggcaatggactaccgggaagcccgcgaatggatgaaagaaggcaaagtgcaaggcattctgtatattccgcatgatttcgaaacccgcgtctttcaaggacgggaagcagtattctcgctatacgccaccacagatgcctttctctatttcgaggcgttgcaggaagccacttcacgtgtataccttgccctcaatgatgcctaccgcatggatggtgccgtattccttcctccgcagggactgcttgccgtaatgatggctaaacctgtcaacatagcaggcacggcactctataaccacaccgaagggtatggctcctatctgattccggctgtcatgatggtcattatctttcagacattgctgatggtcatcggtatgctgacgggcgacgaatatcagcaccgtgccacagagccgttacttccgggattcaggacgaccggtaaaaacgggctttggggagcggcaacgcgccttgtggcgggaaaaacatttgtatattgcgggctttatgcgatcttttccatgttcctgctcgggctgttaccccacttcttcagtatcccaaacattgggaacggactgtacatcaccgccatgatggtgccttacctaatggcaacctctttcttcgggttggccgcctcgcgtttcttcaccgattcggaagccccactgctgatgatcgctttcttctcggtgggactgattttcctgtcgggagtctcctatccgttggagctgatgccctggtattggcgtatgatgcactacatcatcccggccgcacccgctactctcgccttcgtcaagctgaactcgatgggggccgatatggcagacatacaaccggaatacattaccttatggatacaggccgttgtttatttcggacttagcgtgtgggtatacaagaagaaactggaagcgtaaaccagaagcgcgagcccttccccaattcggaagtgacgccgatacgtccgcccatcttttcgataatgctcttgcacaaaggaaggccgaggcccgtaccctatacgaaactgtctactttcataaagcggtcgaaaactgccgtctgattctcagcagagataccgatgccggtatcttctacaaacatttcaagctgccgggcggcatcgatctggtaaccgatggtgatagtgccccggtgcgtaaacttaatcgcattgctcacgaaattggtaatcacctggttcaagtatccgctgtcggcgttgaaccaggcatcgagcggtgagtcttcatcgatccgtaactctactccttcgggtactctatccttcatcttctgtagcatcatggcacagaactgataaagataaacaggcttcggcacatactcaaacgaacctgcatcgatcttagaaaggtcgatgatatcggagaacagttgcaggagcaatacgttgtttttctgtatggtctggcggaactcttcctgctccgccggatcgtccactgtcatcagaaggtcggaaaagccgacaatggcattaagcggcgtacgtatttcatggctgatatttgccagaaaagcggacttcaaccggttggactcttccgctttatcgcgggctgccctgagctctgcctctgtttctttctggaccgttatgtcatagttcacctctactaattccagtctcggatcgggcgactggtaggaagtcaccatggaagatttatgtatccagttccattcgtccgaaccctctgcccggcggatacgcagatcaccgtcaaagaaacgttccgtacccgctttggccttttcatagaaatcgagtaccaacttccggtcatcggggtgcatgtacgaaaacacaccgataatatccgtcagcggcgtgtcatggctttcacccagattcctgtaccactggcggatggcgtatccggtgtgatccagcaggttgattttcgcatatcccaccttggaatagtcggaaataatagagaagaagttctcaaagtcatgtactttgctcagtgcattattgcgttcggtattatctatattcatcagcagatagttcgacagattcccttccgcatcatagagcatcaggctccgcacatcaagatcggccatccctctccgttccgaccggaagagcctgcgttcttcgtcgaagttataatgcaaatgaaaactgccgggacagccggcttgaaggctttcaagcatatcctgagtcacattgggactctcaaacaggctcaggccgatgatccggttcttgtctgttactccgaatatctcgaggttccggttattgcagtccagcaacacgccctccttattatatagctcgagaccgaccggaatgttgttgaatatatcgtgaaacaacttatcgctacgttggctccatacgcactgataaccttctgtctccgggttttctatccgttggctatatccggtagcaatcaagctgtccttcttcattttcctcttccatgctcagtgcgcagtgcatccagaagatgttaccgtggctggaagatacgggaaaggtctgttcgaatactcctttttggggaatggacatgaattcgtccgtaatgcgtttgcgatagtcccggcgtacggtggacattaattcgtctatgctcaacaattcactgctgacttccagcgccttaagcagggtttccgcaataaggcattgtcctgtgttaaagttcacttcccaccatccgatttgtgcatcggcacaaatcttattcagtttggctacattgtccaaaggagttttgctaatcattatgtttgctttgttttgacagaatttgggataggctccttattttttctttgtcttatatgcgaacgactgccagcgctcttccggccagtcctgttgttgcatgtcatagcgtgccataacaaaaaacaggtcggacaagcggttgataaagcttaggatttcttccgggacggcatcttgccggttcaaagtccaaagacggcgttctgctcttcggacaactgtgcgggcaaactgcaattgggcagaaaccggtgtgcctccgggcagcaggaaataaccattctctttcagctcggccgtcatcgcatccatttcctgctcacagaaggttgccagatgaggtgatagactgttcgggttcttgtcgcgaatggccgacggggtcgctacatgactcataaccaccatcaactcctgctggagggtatgcagcaacctttgccaatcatgtgtttgcggaagcaatgaacggatgatgccgatcaccgcattcaattcatcgatggttccgtttgcttcaatccggatatcgtctttttctacccgttctccaccatgaataccggttgttccccggtcgccggtccgtgtatagattcgtttcattattcaaataatttaagtaaatcaatctctccccagtatagatgcgtgtaactggctatcacgtttttgtatcggaacacaggtgtaccgacaggtattcccttggcattgtatgcctgagtgacagactccggcagttcttccgtcttcggttcgaattgcgtatagtggaactcgtggccgcgaagatgctgtccgttataatcgaaagaccgataccccaacgtcaaacgcctatcagctttacggcttgaaatatagaaaggaaatacccctgtttgcggtccggtcgcaatccccggatgttccggccggtcgaagagaatacctttagaaaggtaaatcatccctccgcattcggcaagcacgcgcccgcccgcctctacatagttacggacagactgcattcttcgccaagcccgactcagccgggtatgacatttctccggatagcctccgggaagatagagcagatcggttcctttcggcaacggacgattgtgttcaggattgaaaaaggtaacggttcccaaacggcaaagtatatccagatgttcctgatagatgaaagaaaaagactctgcactgcatgccacggatatttttaaatctccttgtcggaaagtatccggagtagaaggtatgggggcaggaagcattgtctcttcaagcaggcgggtatagtcgatgtgtgtttccattaaggcggtcaactcctcaagtgcatccgtccctcccgaacggctgaagtccaaccccaagtaacgggattcctgcaccagattctcccgcttaggcaaatatcctaaacaggaaatacccaattcgctacatacttcctgtagcatttcgtaatgacggggagaccctacacggttaaagataactcccgctattcttatctcaggacggaaatgaaggaaacccgaaagcagaggagccatcgagtaggccgccgacttggcatcgactaccaatacgacgggtaaattcagcaagcgggctatttcggccgaagaaccccggtcacggtcatatccgtcatacatgcccatcatcccctccacaatacaggcatcggcccctgtggcatagcgggcataaagttcccccacatgctctgccgaagccataaaggtatccaggttaatggaaggacgcccgcaaactgccgtatgatatttggtatcgatatagtcgggcccgcacttgaaaggttgtactttcaaccctttctttatcaatagtgccattaatccgcgactgaccgttgtctttccgctgcccgaagaaggggctgctatcagaaactgagaaatcatcctacactccatattgtcagtttttatcctgcaaagatacggatatttctctctaagggtatatctttgtctgtaaaaatgcgctatggctgctgggtcggcaccagttccagaaacatggtcgtggtcagtaaaatcccgatagatacgcagacaagaataagtaaccaattaatatattttgctttaggcttggtatcggcatgcagattgttgaggaaatactcccggaaaaagaggtataatgcgggaatcgttgcactggccagcaaaaaatcttccggaatattaaagaagtaagttttcgacaaaccgataagagaccaatggcacaggaacaataccagaaacatattcactttgcgcgagaataacagaagcagaccgatggtgaaaacggttaccgagcaaggcatcaccggcgatgtaatgccgggaaaagcaagtccccttgcgacagacaccaaaggatatacgaatggcaaagccaacagcacgtacgaaagcatatcgtatttatgcgtacgctcaaaagtggtatatccggtgacggcatcccacacccatatcgtagccataacaatccaaaacacagccaatgccccgttatagctgcgctcgtcacaacagatggcatagtatgcgatggcaatccacaaatacagaaaaaccatatacagtttcatgcccatcttcacccatggacggggattctttattagcatcactgtcagcagcaagccggcaacaatgatcagcaactgatagatccaggtagcagaattataatacgcaatagttttccagaatatctccataaaatatagattcttattaaacagattaatttattaatgccgcgtcagggaaaatgctttgtgaggaaacaggaacatggggaaagtggctcccaccgccaacataaagataacggtacaggtcaccagtccgttggcaaagaatgtctccatgtatttacccagccgctccggctcgttcattgtttgcagactcataatcagtgaaaacaccatgttataagcaaacttacccggaatcatcggaagcaatgccggtatatagagtacggtcatcgggcaatatactttctgcccgagccacaagctgccgaaaccgataatcaatgctccgaacaaagaagccgtagcaatatccacccccagaaaagtcatcaggcaataacggcaggcatgtccggcagccgcaagtaacgcaatcatcttgaaagcccgcaacggcggatcggatatagccccaaaaccaatacccgcaattgcggcaaaaaatccatcggaaagaatatctaaagctatcatatcaaactgtttttaaccattaacaatgtaaacgaaagacctatcgcaatgctgacaatcagcagggcagcctccgtcaaccgggcaaatcccgtgaggatatatccttctacaatatcgatcacaccattgatcagcggcacgcccggtaccagataaagcacgctggttgcaagggctatctcagaggtagtgtcaaaaataagtgctgtcgacgcacataatgacgcaacaaaagcggaaacaataaaaatgatataatgatttattttcttcttctgcatctgttgcttcaggaaaagtcccgtgatagtagccgaaaagacaatgctcatagaaatgatatcaccaccaaacaacttacagaacgaagcattggcgaatccaaccagcaaaagcacaaacaacggatctattttcggtgccgatataattttattgaacttgtccgccatctcgtgtaaaggcagatgtttgtcataaacctcccaactcaaagcactcaattcagagttgtgttcaaaactgatcggatgggcaggaatatcaattacttcgttacaggcctcacccgtttcgttatcaataatggtcaggataatgtttttatgaaaaacactcaacttcacatccaccccataggcttctccgatacgcttcgagttacggatgacacgtgaggtgtgcacacctgctcccatcagatgggccgaatatccggcaatgaacttggatatggaaatcaaagattcatttgtagtcataatgctcacttttttaaatcgggcgcaaaagtacaaaaaagataggaaagaaagacatgatgcaacctttcattttatccaaatcttgtttcgcaccgcgtaatgttgttatttctaaagttaacctaatgccaaaataaggatttgtgcagtaagtacccgcaggaacatggtcaatggataaaccgtggcataaccaaccgcaggcgcatcgcacgaagtcaggtcattacaataagccaatgccggcggattggtggtcgatccggccagcacaccgatcaacgtgtaataatttaacttaaagacacaacgtccgatgattcctgccaataacagaggaagcacagtgataatgatgccataaccaatccacacatagcctccctcataaataattgtttctacaaaccctctgccggctcccagtcccacacaagccagaaaaagtgatatgccgatttcgcgaatcatcagattagcactcattgtagtgtaggtaatcagtttatactgcggtccaaaacggctgataaggatggatacaatcaatggtcctcctgctaatcccagcttgacaggctgaggaatgccgggaaacataaaaggaagactccctaaaatacatcctaaagcaatacccagaaaaataggaatcagattgggatggttcagccgtttcatcgaattacccaatactttctcagcgtggcttactgccaactcactccccacaatggtaacacgatctcccatttgtaactgtagttgcggggcggctactaaatcaactcccgaacgattgacacgagtgacactggcaccaaaattattgcggatctttagctgtgaaagtgttttgccgttcaattctggtttagttatcaaaatacggcgggacactaactccttattcaactgctcccattccatatcaatcggtttaccaaaaaaagctgtgatagcctccatatctattggagtggcaatcaccaatattttatcctgcaggtgcaataccgtatcagagttgaccagctccgtctctttctttccgtcatggtgacggatacgtgatacaacgaaattgcggtttaccaacggacgtatttctttgattcttttcccttccaaggcttcatttctgacttccagagaaacaggccggacagttagttcctgtagatgtcccaacccctgctctgcgtgggcttcctcttgttttgtattaatatgaagaagatattttagtcccagcaaagacaaaatacaccctaccactcccaacggatacgccacggcatatcccaaagcgatctccggggcatcaattccattcaaatcactatttgcctgttgagccgcacccagtccgggagtattggttaccgcccctgaaaggatgcccaccatggtcgttataggtatacctgttataagatgtatggaaaccgtaataatgactcccgcgaaaacaaccgtcatagccaatacattcagtgtaaaacctcctttcttgaaagcggaaaagaaccctggtcccacttgtaaaccaatggaataaacaaacagaatcagtccgaattccttcagaaaatgaagtaagtgctcgtccaggttcaaattaaaatgcccgaatacaatgccgacaaataaaatccaggtgactcccaaagaaatacctgccacttttattttagccaacatgataccaaatgcaatgacaagcgacaaaataagtacggagtgtgccactcctccaccccataggttggggtaaccttcaaaaagatttcttaaaagttccatagtataatatagttagattcgttcaatacttagctttccggaagatgtgtcgtccttcacgctatgtgcaatgtcctccaagcatgaatgacacaaacagtctgtgtaattttctttaatataagcgtattggaatgcgtccagttttacacttgcacaatgacacaaccttatattgtcatgccggcactcaaaagcagcaccacaacgaggacatacctttttcatcggcataccacctttccatcttttttgaagttaatcttttttcgtactgctttcctaatcccacgagtaaaaacagcctttgatgaatggcaggtcttctgacttactccttatcctgaagccttcccgatgtttcaaatccgacaccagtggcaaaagatgtttccaagatatataaacggagcttcacagcagcgggactgtttgggacttacacccaattcccttttaatccgaatgacgagaatcttcatccgaaaccaattcggaacaaagataaagaaaaaaacagagcggggaagaataatcaataagaaatgtaaaatacaatcccattcagcatcttccatcattgacattttgacattctgtcatcttgtattttctatgtggcttgtagcacatttttcggagtctgtcccaggcttctccggaaaaagcgccgtatttacaattctccaaaaacaaaagaacattcgtgaacatatcttctaagcaaattaaaatgtatccactgtattttgtagcataaagaatataaataactaatattacaatccaaacgattaatccggccgagcatcgagacgaagtcaatcagcataagaaacagagcttttagtgcctctttttagagtgttaacctcacccggatacaatgttaacttcctctgaacgcaatgttaacttcctccgagtacgatgttaacttcatataaagacaatattaacttcctaaaggcaagaaatcgatcatctctgatcatccaaagtatatttaatcacaaaacagtccggatatcgtatactaatgccatatttatgcggactacttttctatttcacacatatagaattcttcccttgttttaaaaacagagtaaatcccttctttctgctacaaataagcagtaaaccgcgtccttttgactgaaagacatccgcctttcccaatataaaaggcttcacttctccgatatacctataaataagtatattctttaatttatttctatataaactaataaatgtatatctttgcccccgcttaggtgatgcagtcgaaacattccgttcgatgcataaaagggaatccggtgagaatccggaacagtgcccgctactgtgatcctttttttgtaaatattcaatatttgcaaagaaaaaaatgaaaagcattctgcatatataccactgtctaaactgaaaaattatgatgggaaggtagctttttaaaaaggatagtcaggaaacctgcctaagtaaatatagtcaatagtgttatctcggggtcaggatagccttttattaactcttttctacttaacttatgaataagaaaagcttaaactcttttttaaaagagagtttttgtactttatgtaagaacatgaagtacaaaaagtcatccattgtagtaaatgacattttattcaaaactactaatctgtttatcttatgttttttatttattacatgttttataagttgccaagatgaacaacttattcttgaatcaccggtatccacacgttcaattccaactcctacttttgattgggaaaatgcagattggatgccaacaccaagtgggcaaagtcgcataccaagtccttgggtaggacaaggaagcattgcatcaatttatggtatggatgtgattaatgacaggaaatcctcagatggatgggtattattatataatacattcgaaaccaaagctcccggtccactagttaatccctactttatactttataataaataccgtggaatcatgcgtatttttctttatactacaactcaatttatctcaccatcgacttatcttcaagatgggatttcaatcatctctaatcataaatcatctctactcaattttatgggagaagctatagtagatggaagtaaaaacaaagaaacttactcacaaatgcaaccagctccagatgacggttcacttccattggcatctaacaaatggtatatgatgcaatatgaattagcatatgatgaacaaatagcacaattaccttataactcaattcagttaaactggtatatgaattattataatgttgaaaagattgatctaaatggggacttcgttggaacaattaaaagtgctataggttcatcatctgggaataacattttttcaggattaggaaatgtaggcaaagtaacaggaacaggtatcttagcaggcattggagataattttttatataaaaacaccataaatgaagagactggagagaataagttaggtttgcccaaaagtatattcaaatctgcggtaaaaggtattaaaagtgctatttccaaaagttctagtgatcttcctggcgccattataggtgcctttagtgcaatgtttagtagtggaaatggagagagtaagttaatcaacttaaatatagatgctaaaattacattagaaggtactgctaaaagtagtggttcatttcctggtagtcctatatccttttggattccaggaacctctataccatcttctgcaacaggatatataccttattatcaagaatcattaggtgtatttaattttataggaaagcccaaaatagaagtcacagggaagggagaatacatttactatgattattttgacgaaactcctgtttgggctacattaaacttccccaaactagatctttcacagtatataagaattaatccaaccttaaaaaatatagcagatatacaaataagagaagcaaattttttacttgttccatatgtcgttaaagactactcagatatgaatgtagtatcagtaacatgtgatagtataggggaagggtacattaatacctacacaacgaaatactatgtaaacccgactgaaatcttttatagatttgaagatggtccaagtccagaatcagcctttgatttttatgctcggataattcttgatgttaagccatataatggtagtcccacaatcacgatagaaaaattatttttattagaacaagatttttctaaagtaaatgtaacaatgcgtaattatcactgataataattcataatatatatacaataaaatgagaaacaaaagatgcttactgaccattctcttgggaggatgtgcagcggtgggtgcgtttgcacagcaacacgcaacaggcaaagacaaagagatgactgtggacctgaaccctgtagttgtgacaggtaccggtacacaccaaagactgaaaaacacaccggctccggtggaagtagtaactgccaacgaaataaagaaagccggtatcacagactttcagcaggcaatgaccatgctcgttccttccctttcattctctaccaactcaatgggttcttacctgatgatgaacggcctctctaacaaatatgtacttatactgattaatggccgaaaactgacaggagacatatccaataacatcgacctttcgcgcatcgacatgagccgcgtgaaacgcatcgaggtgcttgacggcgcaggttcatcactttatggttctgatgccattgcaggtgtaatcaacatcatcaccaatgaaccgaaagaactgatgcaggtgacttctaccacccgatatgaagatcatcgccaactgacacaaatggtaaatgcggacatcgctaccgaaaagttcggttcgtatacctcctacaaacatgaacaaagcgcagggtggagaaacagtgacttagcatacgtaacagatagtaaaacaggagcagtatcaactattcccaccgtatcgcctacatccaatggcttccactcaaatttagtaaatcaaaagttcactttccaaccgactgagaagctctctttctatgctaatggaggttactactggaaattaacagatcgccctgtatacgataaaagtatcgacggaggttctaaatatgacttgcattacgaatcatataacttcggtgtaggcggacgctataaaatcaataagcgttcttctattcagttggatttgatgaatgacaactacatgcaaaattataaatatactgtggctgacgacaaaagcaagattgccatcggagactatgccaaaactaaagaacaacatttctatgacgcagagttaaaaggtatcttcaattttgccagaaacaatatgactgtagtcggagtagattaccgttcagaaagcctggaccgtcccagtacaaaggtagataagtctgtgtatacagcatctgcttatgcgcaacacgaaattaaattatggaattgtctgaccggtattgccggtgtacgctacgattatcacgaactggcaggaggacgctttactccgaaagtggctgtgatgtattcagtaggtgctttcaatattcgtggtacttactccaccggttaccgtgcccctggtctggacgaactttattattatatgaataaaggcaaaacgatcacacaaggtaataaagatttgaaagcagaacacagtaattattattctgttaacttggaatacaatacaaaccgcttaaatgtctctgttaccggttatttgaattatatagatgatatgattaattctactacatataaacttgcagatcttcctaacggtgaagagttacgtgctcaggcccaaaaagagttcaacctgacagactctgaaacaaaagcgttagctaactacaaactctacggcaacctcgacaaaggtgttgtcagaggttttgaagtaaacgcagccaccaacctcggtgcaggcttcagcctgaatggaaactatgctttcgcttatgcacgtggtaaaagtgtggacggtgtgtggggtaacatcgaacgctcggtacgccatacaggaaccgtagcggggaattacagccattcctgggatgactatctgctgaacatcaacatcaacggacgtttccagagcaaacgcttccatccgggacacagctatggtgacgctccgggttatggggtgtggaacctgaacgtgaaacattcactgacaggattcgaacacctgggactggacttcggcatggggctcgacaacattttcaacaaacgtgatacccgtcccaatggcgttaactacgcacttctttctccgggacgtatggcatatgtaagtttaactctccgattcaagaaataaccaatgaaaacatctattctctctttactcttgttagtttccctcttctgctccgcgcacgaagggggaaacttcgtggcctccgatatgctggccaccatgcaaccgggcgataaagccgcccttcttatggtacacttcggtactacatacgatgacacccgtaccaaaaccatcgatgccatcaatgccaaagccaaagaagcattcccgcaactggaaatgcgcgaggcttatacttcacgtattgtcatgcgccgcctcaaagctcgcggcattgagaaacccagtccactggaagcactgttgaaacttctcggagacggctatacacatgtcattgtgcagagcactaacattatagaaggtgttgagatggagtcgttgagacgtgacgtagcctcagtagcgccattctttaaagagatccgggtaggtaacccgcttctttattcggtagaagacgctgaggctgtggtggatatcctgggcaacagcaagccggaaaaaggcagtgtggtcctcgtcggacatggcacttataccccaagtacagctacttatgccatgatcgactatatgctgaaagccaaaggattgaaaaactttcatgtaggtaccatcgaaggttaccctacattcgacaccatgcttcagcaactgaaggataacaaaaccaagcaagtgacattggttccctttatgtttgtagcaggtgaccatgccaacaacgacattgccgtcgactggaaagaagctcttgaaaaggaaggcttgaaaatagatgtacgtatgcagggattgggtgaaatacccgctatccaacaactgtttatcgaccatgcccggtttatgctgaagcacaaaatggtggacattatgaagaaaaaagccaaatatgcaaaagaaaaagacgaatgaaaagagtgatattaatggcaataggcagtgcactattgctcccctcgcaggcacagctgcaaaacaaaaaatataccaacttcaatgattctatattctcaatcaacgaagtagtagtgtcaaccaactacagacgaaagaccgatgccctgaaactggatgttcccgccaagttcattcccatttcaaccaattcaatcacttccggaatgcttgagaaacgaaacatccgggacatacaggaagctgcccgtttcctcccaggtgtacgcttccgcacctcctacggagcctttacgcagttctctatccgcgggttcgataattccgtgattatggtggacggagtgcgtgacgaacgttcatccatcgacaattcctatccgtttatggacctgtcttccgttgaaagtatcgaattgctgaaaggtccggcttcggtactttacggacagtccgccgtaggtggcgttctcaacattgtccgtaaagctcccgtaagcaaacaaagcgtatacgcacgtctcgcttatggcagttattataacaaacaggctacaatggcgttaggcggcaaactggtaggtcccctaaactatcgtgcaagcgtcaactggcaagatcaggaaggatggagaagcaatgctaccaaacgtctttccggatacctggcccttggcggccatctgactgaaagcgacgaactggacatccgtatcggcgccaaccgcgatttctatccgactgagatcggtttacctcccacaatgtcttatgatatactctcagccacagacggcagcaaatacctgagcaaaggagacgctctgcccggactgaataaaaaagcccgctacaacagtgaatcggactttatgtacaatcgtggtttcaacgcatccgtcctgtataaacacaccttcagcgaagcgttcaagctgatggacaagctctcttatacgtatgacgatattgattacttcggtaccgagtcattggactatctgacaagtgacagccctatctatgatcattattacatgaccaaagacgagcaaggtaacgacaccaaaaagtatatctgtctggattccatctattacagttatccgctacgcttctcacatatcgctaaaactgtgaacaaccaactggaagcaagcggtaagttctataccggagacgttgtgcacaactatctgggcggttactcttttgtatccctgatgcgtgactcttacatggcttatcgtaataaaagcactggagccaccggccccggaaccacaggacacggttcggtatataatccacacagcattggctggatggaagcgcctttcagatttgtcaccgcacagaaaacattcacccacggattttacctgcaagacttggtggagttcagtgataaactgaaaatgatgctggcaggacgttatgacctgttcatgtacaagaccgccaacctgaacaccagcgacggaggacgccattatgacaaaccggatgacgatgcatataacaaaatcaccaacggtgccttcacgttccgtgcgggattggtgtatctgcctattgacaaagtgtccatttacggttcatacggtacttacttcaaacctatccgcgcattttatgacgctaataccatttacattgataaggatggtaaagagtttattccggtaaatggcaaagaggtattcaagccggagaaaggtttccaggtagaagtgggagcacgatacgagatcacacgtacgttgcaggctaacgtaagcttattctatattaataaagataatatccgccagactcttgcaaacaaaggagacattgccaatggtgtagaactggacaaaaaagttgtagggcaagtgggtagaatggattccaaaggattcgatattgatattacctggagtcctgtttacaacctgtctatcagtgccggatacggatacaccgacgccaaagtccgtgacctggccaacaacccttatatgcagacaaacgcaagcgaaggcaagcagtatgcttatatccctaaaaatactttctacgctttcggtgcctatacggtttcaaaaggtatgctgaaaggtttgggagtgaatctctctaccagtttccaggacaaagtgtaccgtaactcggacaatacaagttcgttcgatgcttactggctgaccgacctcggtctctcttatacattaaagagcaatgtacgtctgggagtcaatgtcaacaatctgttcaacaaggaatactgcaaccaggcacttggcaatcaattgataccaagcatgccacgtaatttcatgctttttgcgtcttatactttataatgatgatcacgaaattgatgtataccattcacagggtactgggcacactgctcagtatcctgtttttagtttggttcctatcagcttttgtcatgatgtaccacggatttccacgtgcatctcaagctgaaaaattagagaaactggaacccctgtctccttcactgccttctgtcggcgaaatcacttcccgactgcccgaaggtgaaaaagtgaaaggaatccggatagaccgatacctcggacagaccgtcttccacatccgcacggacaaaggtgaccataatctgcccgctgactctgctcaggtactaccatctgtagacggatcccgtattcgccggacagcgtccctatggtgcagtgcgccggtggagcggatagatacgctgaaccggctcgaccaatggattccgttcggtagcctgaagaaggagtttcccatttataagttccattttgccgatgcggagagacaccagttatacatcggctcacaaagtggagaagtattgcagttcaccacccgtaacgaacgtttctgggcatggctgggggctattccacattgggtttacttcacctggctccggcaagatgccgctttatggagcgtcacggtgatctggctgtcgggcattggctgcctgatgacgattgcaggactgtggataggtatcgacatctggcgccgctcacgcaaacagggaaaaagtttctctccctatcgcaaaaagtggtatcactggcattatgtgacgggaatcgttttcggtctcttcgtgctgacattctgtttcagcggaatgatgtcactggcagaagttccgtcctggatcagcaaaccggtattggataaaaatcccacacgcgaaataaagaaaggagcaccgaggttagagcagtatgtgctggattaccgccggatattaaccgaatatcccgacgtacgccagatagaatggagtaatttccgctcgcagccttactatatagtaaaacgaagtgaaggagatctatatatcgatgcatcggactccctgtcgcgcccgctgaaactggacgaaaagcagataacggatgccgtgagagccatacatggtgacagtgcccggctacatgtaacactgatcaacgaatttgaaacctactacagggatatgagcaggatgtaccgtgaccgcagtctgttgcccgtctggaaagtcactgtcggcgacgcagacaagagttgttactacatccatccggaaacggccaccgtacgatatgtgaacgatacggcccgttggaaatactggatgtacaccgccctgcaccgcttacgcatacagggactgaactcttcgcctacactccgtaaaaccgttctttgggtactattgctgggcggtactgtctgttcgctaagtggtgtagtgctcggagtgaggtacatcgaacgtaaatgcagaaagaaaataaaaagataaaatgaaagggtccacccatctttatgttcccgaataaaaggctaaaaacggattaatccgtatctttgctacatagtttctctaaatcaggaataggaaatgaatcaggttcaccacagaggacacagaggacgcagagaatatctttctcttaaacatccatataaacaagagattaaaactctgtgctctctgtgtcctctgtggtgaataatactcaaaaccgataaattatgaaacaacccaagataatcgtagccggcatcgggccgggaagtgaacaagatattacccctgcggtgctcgctgccgtgagtgaagcagatgtagtggtgggatacaagtattattttcgttttatccgtgactttgtccgtccggatgccgaatgtatcgacaccggaatgaagcgcgaacgggttcgtgccgaacaagctttcgaatacgccgaacaaggcaaaacagtctgcgtcatcagttcgggcgatgcaggtatctatggcatgactcccttgatatatgaaatgaaacgcgaacgacagagcgatgtggaaatcatcgccttgcccggaatcagtgctttccaaaaagccgcctccctgctgggtgctccggtaggacacgatttctgcgtcatctccctctccgacctgatgactccgtgggaacgcattgaacgccgtatcatcgccgccgcacaagccgattttgtaactgccgtctacaaccccaaaagcgaaggacgctactggcagctataccgcctccgggaattgtttctgcaggaagggcgctcgccggagactccggtgggatatgtccgccaggcgggcagagatgaacaggaaatacacgtaacgactctttccgcattcgatccggaagaagtagacatgttcacggtcatcatcattggtaattcgcaaacctactctttcggtgaaacgatgattactccccgcgggtattatcgtgagacaaaagaagacgcaaccggcatcggacaggatattatgatacgcagtttccgtaccatcgatggagaattgaaaaacaaaaacatcccgctcgaccataaatgggctttgctccatgccatccacacaacggcggactttgatatggaaaaattactctacaccgaccccggtgcagtggcttcactttatcatgccatcggtgagggaaaattgaaaacgattgtcacagatgtgaccatggctgcatccggcattcgcaaaggtgccttgcaacgtctgggtgtcgaggtaaaatgttacctgaatgatgaaagggtagcagaaatggctgcctctaaaggcatcacccgcacacaagccggtatccgcctggccgtagaagaacacccggacgctctattcgtatttggcaatgctcccacggcactcatggaactgtgcgacctgatccgcaaagagagagcgcacccgtccggcatcgttgccgctcccgtaggttttgtccacgtacaggagtccaagcacatgaccaaacccttcgttcacatccccaaactgattgtagaaggccgtaaaggaggcagtaacctggcagccacactggtcaacgccatcctctgttatccggatgccgaacaattaagaccaggaagagacgtttaaaaggagagaaaacccattagaaacttaaagacatgacagatcaccatcatcccacccaattcattgtcatcggtctggacgacagccctgctccttatctcccaccctcgatacaggtactgatacgcgagggtaaggtcttttctgggggcttgcgtcaccatgacatcatctccgccttccttcccgaaggggcggaatggatcgatatcactgtccctctcgacgcggtatttgcccgttacgaggcctacgaccacattgttgtcttcgcttcgggcgacccgctctttttcggattcgccaataccatccgccgacgtttgcccgaggcgaggatacaactttatcctaccttcaactccctgcaaacactggctcaccgattagtcatgccttatgacgacatgcgcaccgtatccctcacagggcgtccctggcatgaatttgaccgggcactgatagaacgcacaccgaaaatgggcattctcaccgacagggaacacacccctgccgctatagcccgacgtatgttggactatggctacactcattatacgatgtacgtcggcgaacatctgggcaacccggaacgggaacgtatccgccggctggaacttcaagaggcggcagaactgacctttgaatatcccaactgcctgattgtccatcagtaccccgacacctatactcccacccaccccggagcgcgtataagtctccctccactcggaatccccgatgaagagttcgaactgctggacgggcgcaccaggatgatcaccaaagctcccatccgtctgcttacactcagtgcgctggaactgaatcgccgcgtctctttctgggatgtcggtttctgtaccggctccgtatccatcgaagccaaactgcaattcccgcacctgcacgttacctcctttgagatccgtcccgaaggacaaagactgatggaggtcaacagccggcgtttcggcactccgggcatcaccatcctcataggtgatttccttgaagccgacctcgacaccatttcccgccccgatgccgtctttatcggcgggcatggcggacatctgaaggagatgattgcacgcatctcccattacctccttccgggaggatgcattgtcttcaactccgtatccgaagaaagcaagtcgctctttatcgaagggataaaagaaaccggactccggctcctcagcggaacaagaattgccgtcaatgaatacaaccccattgaaatactcaaagccgaacaacaatgaaaacagctattatcgtaatatcagaagccagcatatccatggcgaaaaccctcaagcaggaactacctgagtctgaaattttctctaccatcgcaaatgccgactgccagcatatcccggcccttcaggaggcagttccacaactgttccgcgactccgacgcacttatctttatcggggcgatgggcatttgtgtgcgtgccatcgctccctgcattgaagataagaagacagatcccgccgtgctatgcgtagacagtacgggacgctacgtcatttccgtactctccggacacgtcggcggtgccaacggactcacccaatatgtggcaggcattctgggtgccgaacctgtcatcaccacccgtagcgaccgcaccggactctgggcactcgacaccctcggaaagaaatacgactggcagcccatccccggcgaaaactgcgacatgaaccacctgatctcccttttcgtcgaccgtgcaccgaccgctctgttactcgatattcgtgacgaaggcactgcccaactggaacacaccttgccgtcacacgtagatgtgttctataacttcaaggacatagataccggcaaataccgcctgttgctgctcgtcactccttatttgtatgaaacttccggcatgcaagcactctactatgtacccaaagtgctgcacatgggtatgggactggcacgtaacgccggcccgaagaatgccgtcatcacccgcctgatgaacaccttactggaggcaaacatcatacctgccgccattcggaccatctcctccattgaagagaaaaagcatgaagaagtactgaaactgcttgccgatgcttatgaactgcacttgtacacagccagtcaactcagccaggtagatgtacctaccccaagcgaggtagtcgataaatacatgggtacgcccagcgtatccgaagcctcagccttgctgacagccggaggcggcccgctgattctgccgaagcagaaatgtgagaactttaccgttgccatcgccctggacagcgcagccgtacgccaagggcacatcgaaattgtgggagccggtcccggcgatcccgaactgatttcggtacgcggacgccgtttccttgaagaagccgacctgattctctatgccggtagcctcgtcccgcgcgaactgaccgaatgtgccaaagccggagccaccatacgcagttcggcgtccatgactcttgaagaacagtttgccctgatgaaagagttttacgaccgcggacagctggtagtccgcctgcatacgggcgatccctgcatctatggtgctatccaggaacagatgaacttcttcgaccgatacggcatgcgttatcacatcactccgggcatctcgtcattccaggccgcggccgctgccttgcaatcacagttcaccatccccgagaaagtacaaaccatcatcctcacccgaggcgaaggacgcacgcccatgcccgagaaagagaaactcagcctgctggcacgttcgcaaagcaccatgtgcatcttcctcagtgcgggtgtgatcgatcaggttcaacaggaattacttgaacattatcctcccactacccccgttgccgcttgttatcatctgacgtggaaagacgaacgcatctatcgtggcgagctgaaggatctggcacaaatcgtaaaggagaacaacctgacactgaccaccatgattgtcgtaggcgacgccatcgacaaccgtgaaggattatcacgcctgtactcacaccaattcaaacatctattccgtaaataaaatgatactgatattaggaggaacaaccgaaggaaagaaggccgtcggcattgccgaagaagccggaaaaacttattactattcaaccaaaggagacgaacaggaaatcagcctgcaacacggaatacggctcacaggtgcgctgacccagaccaccatgaaagccttttgccgaaagaacggtatccgcctgctggtggatgccgcccatccctttgcagaacaactgcacgcaacggtcaccgccgtttcacaggcgctcggcatcccttgcgttcggtacgaacgcatgtatgatgacctgttcaagctgtttaatgaagagatgtacgatgaatatccgctcaaattgagggaaaagtacgaagaactgtcagagttactcaacgaagaaggtatacatcgggtacttgccctgaccggggtccagtccatccccaaactaaaacccttctggaagaaaaaggaaagtgagtgttacttccgcattctcgaccgcgaaagctcccgcgagatagtccggaaggcagactttcccgaagaccgcctggtctattatactcccggcaaagagaacctgcccgaactcctccggcaactctctccggaagtcgttcttctgaaagaaagcggcgtgtccggaggattctccgagaaagtgaacatcattaccgaacagggaatccgtctttatatccttcttcgcccttctctgcccccgtatgaccagacagtgaatggagtgaatggaatgcgccgtgccatcgagcactttttgcccgacttcctgcccctgcgcagcggacttaccaccgggacatgcgcaaccgcagccgccaatgcagctctgcggaaactcctgtcgcccatacccggaaatataataaaagatgtttccgttttgctccccaacggagaaaagattgccgtccctgtccattccgttaccggctcgttcactgaccggcgcatggaagtctcctgcactgtgatcaaagacggaggcgatgatcccgatgtcacgaacgggctacccattgtagctaccgtatccatcgatatttctgaagaaaagccgcacaccggaggtgagcggcaacaggttatacaaatccacggcggacagggtgtcggtaccgtcaccctacccggattgggactggaagtaggcggaccggccatcaacaccactccccggcaaatgattacagaaaatctgctgcacatccttgacagacacacccccgtgcccactgcccccatacatgtcaccatctctgtccccggaggcgaagaggttgccgctcgcaccttcaatccccgcctcggtgttgtaggtggcatttccattatcggcaccagcggtattgtgaagccattttcttccgaagcatttgtcaattccatccgtaaagaaatgtcggtagcccgggctacaggttctccccgcatcgtcatcaattcgggtgccaagagcgagaaatacatccgcagcctctaccctgaattaccctcacaggctttcgtccattatggtaacttcattggtgaaaccatccggatcgctgccgaactcggcatccggcaactcacgttgggggttatgatcggtaaagccgtaaagctggcagaaggacatctcgacacgcatagcaaaaaagtaacgatgaataaggaattcctgaaagagatagcccgtcagtccgggtgcaacactgccactgtaacagccatcgaaggcatcacgttggcacgggaactttgggaactcctgcccgaagcggaacttcaggcgttttgttcattactgatcgaacaatgccatcgccattgcgacccactgttgcccgacggagaactgactattctgctgataacggaagaagggaaagtgattcgttaactgatcttaattacacacatcattctcttctttgcctatgataccattatccgagtttttctttgcaacatagaaaccacgtccgggcgtccactccacacaaaacaattcactgacgtccggatacccctgccgggcaagattatccttcagccactcttccgttttaccggcactctccaatgaagaatcgtaagtgttcggtgaactcccttgacgagtaaaggtagggtgtacgtcctgaaacaggtttggcctccagataagaaatcggattggcagaggcggcaaaagtaaaactttggcagatcacttcatcaccgggttttatacccaagagaatcaagcccaagtgaagtgcagccgttccggcactcaaggccaccacacgacggtcctcatgtaaatattcaaccaaagattgctcaaaggcatccacgttaggtcccaaagggacaacccagttcgtatcaaaggcctcttttataaagtcttgctcacggccacccatgtgagcaagcgaaagccagattcgtttgttcataacgaaattatctatgtttatttgattactttacatctatttcttactgctaaaacactatacgaaacgtctttagttacaacagaacattaatgattcttacattttctacgagcataatatggaataattaaaaaaataatcaaacggctcattttagagtagcagctttccaaacaattcatcgttgattaagtttaaaacaaacttatctttatttgcatatttttacaatatcaatatttacttattaaccctttcttcataaagcctcaactcatgtacatcatcaaaatctaacagcaacaccactacagatgggtctgttaatatttgttctggtatatccatatccacttcaccctcagaagaagtataccatacatatttaggaaataatggataagtatctttcatacgaaaatacatcacatgattggaagccagccccgtgataggatcattttctattactccactaatttcatcttttaataacaggatgttactttcataccaatgcccaacatgccgaatagtatatattacgttataccctttacccgtcaaaaagtcaactacttcatccacatttgtttcaataaaaacattaggcaaagggggtatttcccggcaaaattcaagaagaccttttaaagtatattctttcaaatctatccagaaatagtctttgggatgcttttttatataattgatataatcgataaaagaattcgcttttcccagatcatcatagaaaactaaaagagatgcatcactaatatgcaagtcaaattcaataccattatatcccccttcaatatagtccgaaatattatccaaactattaactttatgttttaataaaataactccttgagaaggcattttctcatcagtcgtacatccatatatacccaacaaaaacagaactataacaataataaatctcataacacagaaattaaatttgcacaatatctccatgccccggaaatatgttacaaccaatagaaatgttctttattctttctatagacttcaaagcttcatttttatcacttttgggaagatttgctactacaccatattgcggtagataggagtcacctgtaaaaacattatttcctattttataacaaagtgaactccaatcatgtcctggggtttcatagacttccagatgtttatttttcgatatctctattagttgcttttcctgtaatgtctctacactatcatactgaaaaacaaatgtatttgaatgatatttagacaaattaagtttatctgaataaagcccctcttttccatgtaaagatgtataaacaatcagttgagggtacacctcaaacaattcattcaatccataaatatgatcgtaatgtgcgtgagttataaatactgccccaagagtaaactccttacattgcaaatatcgaacaatagaccctatgtctccacaatctactaaaaagcacattccactttcatcctcaattaaaaaagtgttcgatctaaagacagaattaactatgcgaataacttccatttgctttatctaaaacaccctatcaattataaatggaagatagagttctaactttttactcaaaagttctatctttttcattttctgaaaccttcccagttcttatacctgttgggaagacctttaaaagcattgtaaggattataatttaaaaactgaccctcgtcaagcgaatcaatgattgtcatctcctccgtagtcaacacaaaatcaaatagagaaatgttttcttcaagatgttccctggcccatgttttaggaattattgctatatcctattgaatcaaccaacgtaatactatttgtggaatactttttccatatttctccgcaataggttttattatttcactttcaataatttcttttcttggttcattggatctaaaatgactaaatgtagacattgcttccacacaaattcctctttcctgacaatacttaataagctgtttctgtgtattaaggggacttatttcaaactgattaacagcaggaataacatctgacacatctttcaatgcctcaagatgtggaggtaagcaagagcaaacaccaattgctcttattcgtccctcataatacaaagaagttagctctttatacatttttctataaatcggccaaggccaatgcacgagaaacaaatcaatataatcagttcccaaatgttcaaaagactcttctattgcttttctaaccggtctgaatgatctaatattgaagagactacgtttaccgtacttataaccaaagtaatacaaagcatctgcatttacttttgttgtaataaaaatatcttcacgactaatactattagcttttaaagcctttgctatttctctctcattatgatatctccatgctgtatcaaattgacgataacccatatcataagcttcgcctataacttttgttatattctctttaggaataagaaatgtaccaagtccgactttcggcatttcaatgccattattgagtgtcaaatattccattatttattattattgattacttccattcttgcatttgataccataatccacaacctgatgcgatttgagtaatgtcttcccctggaggaatattaccttctaacagttcaacaccatttggagttatagccaaatcccatcctacatatcgtgcatcaggctcataatatgcaacctcttttaccactgaaacacatttatcaaaatcaggaataataaaactatcaaatttaatatgagaataaggatgcaattcatatttttgacaattcatactataagcctcccctttcaaagtgctgctttcaagatcaatcgcacaagccatacctccatcatgataattatcagttagtgcaaccccgttacccatacgaagtaatgcagccagtatgtgtaattgtttttcccgatctaatacggtaacaatacgaatagtattcaatgaacctggcgctaaactcttaagtttctcacaatttgttataatttcctctattataaattgctctccagcaacaattttttgttccaaaatatctaatgcatctttatagttatcagaagacgtacatattttaaatacaccatgccctccgtaatcttttaaaggtttagcaataacatctctatattgaattataaattccacaatttcagtccaactcttatttactgttgttaaccatcctctatttatatatttccgaaatcgctgattgaatttagctttatcaaggaacaattcatgcacttccggagtactaaaagcatatcttagaacgtcatttcttcgcaatgatatatatgtcttacgttctctattagacttattccaaaacgtaaaagtacaataatcattaaaatcatcaccgtaaaaaacataccagtataacaaatctaaataaataaacgctctattctttgatgggcattttttcaatacaaatttactattaacccaactttcccgaaaatactttaatacagttacaattcgataaaccttccattgtttgtatatagtctgcccaatattcatataaaagctattaatattcaactaaatcagaaacaatcatgttttctgtttcaaactctacactagcccaagccaacccgactccaaacccacatgctatgcaatgattttttttagtagacaacgcatcttgacattgagtaatcatagtaagagggatagaagcacttgtcacattaccaaaatcttgaatacaataaggaactttctcaacaggtatttttagtgattttcttatcttttcattaataaacttattagcctgatgcaagaatagaaaatctatagaatctgtatctatattaaaaatcgaaatcaattcttttaaggaatgcggcggtcgttttatggcaaaagcaaacacatccatccccttaactaccatatctgtacctttgcgaataactcctggctccacctctgtttcttgtaagctattcacggtcgtaggatagcgcatacctccatatttagtccacacagcatcaaatccagaaccatcaacaccataaacaaaattgaatggtttattactttccggagaatattctactgctgtaacagtcgcagcatcaccaaataaaggtctcactgtacgatcctttaaactcctgttctgggtatttgtttcagcagcgactaaaagtccacgtttaaaacaaccatgtgaaagaagtgaaccaattacgcttaatccatatacccaaccagagcaacctaatggcaaatcaaggacaaaacacttttcactcagccccaatctatgctgaagagtacatgatgtttgaggagcaatataatctcgtgaagtacatacgtaaataaagcaatcaatcgtttctttttcccattttaaatcttttattattttttcaacagctttcaccgtcaagtcagaagctgtagttccaggagtcaccatacgacgacgctcgataccagtcaaagtaattgttttctccgcttctgcaatatccttgaaaatagacaaatccttgttttcctctatttgtgtcggtatacaagccgacattcctactacttttaaatgatttattgataatgatgccatagttactttttacataataataaacgttgtttctttcctgataatgttttgggaattttatctacccactcatattctactggcactttaaaatgctcaagtttagccattagacttatcataatatcttcaaatgttaagtttgatgttccttttagtaaataagcctttacaacctgtcccagaacgcctcgaggatcatctatacctacacaaacacagtcctctatgcccaaggaaataatagcgttctctacttccacaggactgactttctttcctccaacattgatcatttcttttaatcgtcctgttagataaataaatccatcttcatctttatatccccagtcacctgttctgaagaacccatccctaaaagcattctgattatcttcgggcaacaagtatgaagaaatcaccatattgccctttacacatatctccccttctgtcttaacaggacattcttttcccatactatccattatttgaatagctacggctgacgaaacaggtttcccaatagaatttaaatgccctttagattgatgaaactctataaacgttgaacgtgaagcctctgttaaaccatagtgcatacaaattctcgtattaggaaataatttcatcagttcctctttctcactagtttgcattgctgcactacctatctcaatatattttatctgatttgcatatttagaaatcttagtaccactaaactttttaatataagcccatacagcggggaccattccaaacattgttacatgatattgctcaatagcctgaaatactaacttgatatttgcaaagtttccaagtatcacaatagttgcgccatttatcaaagtacatctcaaacgccctaatccaaaagaatgacaaatgggtaatcctaaaagttctatatcattagatgtattacccatataattattaatgttataagccgaagcataaatattcaaatgagtcaacaaaactcccttaggattaccagtagtacctgtagtaaacattatgtcagccacatcatgcaaagatacttttgataaattactgataattggcattcgaaagctcacatctctataatcgatagactgaatattcttacaataaaatccaaatatacacttaggatgtaccgtggaaacaatatattgtttcctttcatcattggaagttggatctatcaccacattcctaacacctaacaaatgcgctccaaaataaatataaacaaattctagctcttttcgagctgaaagaataatgttatcaccatattgtaaaccaatataacaaagaaaagatgctgcatcaataattttcttccaaagttcggaatagctcacttgactgttaccctcaatcaatgccactctattggcaaatttttcagcattattactaattgcttgtaataaaggactatgagacaaatccatcatttctttaaagattttatcatatcaacgaatgctgctacagaagtaagttcaaataattcctccactggaaattccacctcaaattgttcttccaaagccgcaataattgccatatttcccatagaatcccattcttcaacatccccaataaaaagattcattgtaactttctcttctgcaatattcaagattcttgaaatagcccctttaacttcttgttctacatccatacaattattttatagaaattcctccatcaacaattaaatctatacctgtgatccacgaagatgcatcggacaataaataaaccgcagaataagcaacatcttccggaagcccataacgcttcaacggataacgttccatatcttctttcagttgttcttctgaaatagttccacgatggaccataggagtatcaaccattcccggacaaatactatttaccctaacttttctcgaagcaaattcttttgcacaaaacttcatgatcgaatttaatgcagctttagacgctccataaatagagttgccaccgctgaatattcgagtaccacctaaggaggctaaaattaccaccgatgccattttattaaatttctttcctttatacaacaaacgaagtaattctacaggactaaaaaaattaacatcaaagattccatcaaatttttctctagatgcaaattgatatggcaaagttacccccctaccagcacaaagaacaagcccatcaatttttactattttactcaacaaaccattcatttcttccatattaagtaaatccgcaataatacactgatgtgccctctcttttccacttaattgggcaaatgtatcattcaatcttgcttcgtcacgagctgatataatcaatgtagctcccatattagaacattcaatagctatagctcttcctatcccagacgatgctccagtgacaagtatcgtcttgttctctaatgaaaaaggatttttcatcttacaattctactaaatcagatatgatcaattgtcgagtctcaaaggcaacggttccccatgaaagacctaccccaaaaccacaacaaacaaacttcgtcaacttattctcaaccttaccttttaattgcgtcactatagtcaaaggaattgaggccgaagatgtgttaccaaaatctatcaagctataaggaacttgctcactattcaattgtaattttttccttatagcttcgttcatctttatatttgcctgatgcaataaaagatagtcacattttttataatcaaaggcaaaatgctcccccaaacgttttattgattttggagctgtagttataccaaaagcaaacacatccaaaccattcattctggtctgtaaacgatgtctcttacgtccatcttcacattcaatcaaatctaaagatctttctgttaattggtttcgggttcctccctcaggctttataatggcatcatattcagttccatccgtaccgagttcaaatctataactccctacacaatcacagtattctaatgccgttacagttccagcaaaaccaaacaactggtctggttcctcataggcttgctttcttgcatcgccaaccataagtagtgctttctttatatttcctccattcattaaactcattaatgtagaaagaccatacacccatcccgagcatcctaacgaaatatccaaagaaaaacactcttttttaaatcccatcttcccctgtaatacacaagatgttgcaggtagaatataatcaggtgtttgagacacaaaaattaaagcatcaatttcatttttattccattttaagtcatccaataaacgttccgccgctgcttgacataaatcagaagtagtaaaatcgtttgaatatcttttttcttttacccctgttgattctatgaaactctctgcttcatacttagaagtggtggagactgttttctccacatgtttagggacgcctgcacttattccagctatactaatatttctaaactccaaataagccattacaatttattttttaccacattaaacaaatcttcgatagtatcagcatttctaacatcatcccccttcaatgtaacatcatattcttcatctaccatagctataacagacaaagctatcaaagaagaccattcatccaaattcttgaactccatctctgcagtaaaaacagaaacatctgtttcatcaaattgtgttgcaaatttctcaataaaatcgattaattccataattgtatatttataaattaatatttaaataatttagctggatttcctatatacagatttccatcttttgtcttacgcatcaaaacactacccgctccaacacgtactttatttccaatatatattttctgtaaaacgatagaacctacaccaaaaagattttcgtctccaatatggacttcgccagaaatacgagtaccaggcataaaagtattgtaagagcctatctcgtcatcatgtcccaacacagcacctccattaaagatgttaaaatcctgaatccgaacattacatgaaaagaaagttcccaagataatatttcccttacccaaaaaataattattaggatcagcacatctgaaatctaaaacaaaatttggaaagtctaccaagttattatgtattttttccaaaattatttttctaatagaagaagtagctattgctattaaaatagctataggagagttccatctattcaactcttcaatcccccctaagatttcaccatattggttatgagcacctttatctatcccgtcatcaaaaaagcccaaaaaattccacactgtttcttgagaattaagccgctgtatggcacaagccatttctcttccaaatccacctgcgccataaattgcaatatctttcatacaactaattatttcctgtgaaaggctccatcgtgattgaattattagaactaattccttcacgaataaaaaccttttttattgttaatagaacaattttcaaatcaagtaaaaaagagcaatgatccacataccacacatccagttcaaatttctttgtccatgaaatgccattacgaccatttacctgagcccaacccgtaattccaggccgaacataatgcctccgagcttgttgcttattatataaaggaagatattgaggtaataaaggtcgtggtccaattaacgacatgtcccccattaacacattgattaattgtggtaactcatctacagaaacagaacgaatgaacttaccaactttagttaatcttttttcatcaggcaacaagtttccctgttgatccaactcatctgtcatcgttttaaacttaataactttgaatatctttccattctttcctggacgttcttgaaagaaaaacactcctgaacctttatttgtaaaatagagcaaaaaaatcacccccaataaaacaggcaaaataatcaataaaataacaataactatagcaacatctatagaacgtttaatataattacgatacatattgttctgcatttttataggtataattcaatgaggctttcaaggagttattggagtaaactttccaaagttcactatcagccttcaacttttttataaaatcagccatagaagaaacatcattttttgaaaaacatcttccacaatgatattcctttaccaaaagtgccaattccgattcatcgggtgctatacacaataaaggactacctatgccaagcaaattataagtcttacttggaacactggctaaagctgtttcgtcagtcaatgttataattgaaatatcagctgcactcaatgaatattttaaacatttcgagtcttgccatgataaaaaacaacaatttttcaacgctttttcctttacacataacattaactcattctttttcaagccctctccaattataagaaagacaatatcttcatctgttctaagtacttcagctatttcaataatagactccacattatgtgtaaatcctatatttccagaatacatcacaacaaatttactaaataaattatgctccctaataaatggatttttcgctttatcaatcctttgcaaagactctattcccgcccaattaggaattacttctattttattttcatcacaatattctaaaagcaaagtcgccattccattactcaatgtatacactttatcagcagctctatatatccgtttattaattttaacccacactttatacatccaagaagatttatatattccaatattattcagcgcattcggatatacatcataaacaataatggaatactgacatttaagaatcagtgatgggaaataagacataggaggatttgtaacataaataattttataatgcctgtacttccaaagtaacaagaaaaaaatttgtaatgtagctatcaaccatgtaagcgcacgcatgaaaaaagaagaacgaatataaacagctattttgtgtattttaacagatttgttcaattctctgtcttgcgtattataacttcctgttagcaaaacaacatcagaatatttttgagcataagcattcacaatatcaaccatcaaatatcccgctgactgatttatcagaagtactcgatcttgaatccttttttgtattttcatcttctccataataacatccgataaccaacttgtatcaaaaagtaaaaccgataccacagttttgtaagcaaacaagcactgcttctctccgatgtaggcgaagcattacctccgtgtcgcctatacaacaacaaaacatcatccacaaaaatggatttataaaaagcttcagcacataatccaatccaaatatcatgcatcgcaatctttttagggaatggcaaaatgatatctaatacttttttcttaaaagccatacaacatcctaaataatgattgtcatagaggttattaaaaaaaccttttcgagtatttaccgatagaaaaaaagaatctttgattatattgagttctttgtctacaatagaacaattactaaccaccacatcatattggtgaaaataagaagtcattattttcactttattaggaagccatacatcatcttggtctgacaaaaaaataacatcaccagttgcatgctttaacgcattctcgaaatttctaataggagatccatacctaatgcccgaaaagatcttaattctcttatcattaagtgtttcaactatttccaaggttttatctgtagagcaatcatctgaaactattaattcatcatattccgaaagttgagcaagtattgattttatttgttgctctataaaaagctgcccattatatgatgcaagacaaactgatattttcatcactattttttacgtaatagataaagagcgatacaattgagaataacacaagccggatgcattaaaagaggattacccgcagaagggaataaatatcccatacaacctaaagaaagtgaagaattaaaaacattttttctatgataaacgtttaaactagctttaaacaatacatacgcccaattgaagaaaagtacgcaagcaaaaattccgaacttatgaataagatttatataagataattcaaagccgtattcagcttcatcactccgagaaaaattaggtattatagcaccaagtcctttccccaaaatagtaatatcatctactatatatgtcaattgcaaataacgtaacgcatttgatgaatcctcgctatcaaacatctttgtgacaatattagaataatcgaagactaccaaaacaccaatgactaataaaatgaaaacaataaaaagaaaaaaacttggcgacatctttcccgaaaccattttcttaccatacaacaagaccggtaatactaaaaaataaaatactccagaaagcataaagcctttcgatgctgtagcaaaatacaaaataaatgttgtcaacaagaacaaccatatataatttctggatttaatgccttcaaacaaaaataagtttttctctgacttaccaattaatagatacataaatgaaagaacccatatagtaaagccaaccgttaatcctgtaaaataagctctcaactgccctgtactagacccttgatttatctcaccgagaaagttatttaaaaatgaactatcaatacctatgatgtcaaaaatataatatacacttgcaatggtggaagtagatatagtagcaactaataatatttttaccaaactagaaaccgaaaccttaaacaaaacaagaaaataatacaagatatagcaaaacattccagcaaaattagctatgatatactcgcttttatttccattaaaaaagcctatcacaataccataaatccatatcaagaaaaaactgaatggtataaaatcaatttcttttctataactgatcttacttttagtacaaaataaatatattagtgatcccacaaaagctatagctaataaaatatagcagacagctgtagagagatttagacctaaaataagaaataatataattaaaaacagattcttcattcgaccattaatgtagctcaattatcactaaccatccttattataaacgccacaaacaaatttcttaatctaaaagtcaactattataaaatattctcaaattcttataacttcctattacaaccaacagaagaaaagaaaacaagaataaacagagtattgcaaatgagggaatatccatataataatcaagacaaaagaaaataggaaatatcagtataaaattaggatatatacaaaactgaactaaaaaatatctaagcgtatttttcttttttacttcctgaacgcttccttcttcattaagataagtttcaaacgaaatataattcctgataacaagctccagcgaaataaaggtaataaaacagaaagatacgagcaaactatcatacttgtctaactgaatataagaaatccataaagcaaggttcatcaaaggatgacaaattaaatgtgccaaataatcaaactcctttccatattttgaaaaacattttgttaccctggccacttctccgtcactgcaatccaaaatataccacatataaaaaaagaaaattccagctaacttagctattccccatggtaacgcaaacaaaacagcacccacacacccactcaatatcattaacaaagtgatagaattaggtcttactttctttgctataaaaaataatgaaaggaaaggagatacagacatgcaaatcaaatcggcaatagatcttgttctaaaatcttgtataggagaatacttcctgatatctaaataattcatcttcatatttattaaatattataatatccgtttcattgtttcgagaaatagctcatcttttttccaatacaaacctccaatatagattatcgtacaacaaactacagataaaagaactaacataaatccagatacgttaacaaagtagctaagaatccatatcaccggaatgaagattagtgataaacccaaatacaacaaattttcctttttaaagatatgcaatgataaatgcaatgcctttttaacatatatcaaacaaaaacactgaaacaatatttcacacaatacagttgtagtgattgctataaaaggagtaaaatgcttcagaaaaacaaaattcaatattacattaagaaccccacaaaaaagattcattaccaataaaatccgttcttttctatgcaaaaagattacttgattatagagaattgcctctacagccagaatgattattctcaaagaaaaaactttaaaacaaggcacagcacttaaatattgttcacctgcaaaaagaagtacaatttgttctgaaagcataaacatacctatggaaacaggtaaaaccagaagcaacattagccgaattagttttctcacactacttatatataagtctttattagtttccaaatacgaagataaacgaggtaatgtcacaaacacaatcgataacaataagactttaatagcttctgctaccttttggccaagactataataagctacatctttagcttccgaatatatgcccaacattgttctatcagccatcgtgtataatacattagtattattcaaaaccaaaatcaataatagcggaataacgtatactctaacatctattttttttacgctactaattatatttctaccaatacggttttgagcttttataaaactaactatattattaagaaaaagagtcccaacaataatcaaaacataaactaaataatcggcagccccacgtactaacaagacaataaacacaacgcttatcaaccttattattacagtctttattgttataaatctaaaatcttcaaaagcctcatgcatccactctatataaaagatttgagctataagattaaagcccaaaatatacattatataacgaatattcggttctttaataaaaatcaacacgaatatttcatatagaacaaaaaacagtatgttactaataaaacctatataaaataagttcgaacatattactccaactttttctctatcatttctatttatactaatttctctcaaaccataattatatattccaagcaaccccaataatccaaaataagtatacaaagtcgtgccatattcaacgtctccgactttttccggccctaaaacccgataaacataaggtaatatcagaaaaggaataagtatgttaaatacgctaagcgtactttttgccaataaattttttagaacagattgccccatcaataattataagttcaacaaaattcctaccaatttatcattttcctcttttcccctcacagctatacgaacatagcttcgaccattaaaagcctttttcgtgctacagtcctttatcaatatatcattttcacaaagtaagatgcgagttaattcagatgaggtatatttattcgtaacttcacataaaaagtaatttgcttgagaaggaatcacacgaagaaaactaattctctgcaaagacttaaagaaacgagaacgttctgctacaaacttttcacaagccatcttataatctgattcatacttgccgaatatctgcatatagaattcagcaaacgaattaatattccatattgctacattcgtcttcatccaagaaatcaattctatatctgaggtagcaagcactcctaaacgaagtcctggaactccataggacttagatatgcttttcattacaatcagattaggatatgattctaacagctcattataaagcagactactatttaaaccatccattgcaaaatcgacaaaagactcatcaactatcaaatggatatttctccttttagcccaaaaagccaattccaaaagatctgttttagaaataaaattaccagaagggttgtccggattaaccaacaataaagaagaaatatctttatgctcaaaatagagttgaatatcctctactgtataagagaaatcagtattatcaggaatataagaaattatagttcggctctctcgcctatttggatattcttcaaaagtaggataaataactcccaaattgccatctaaatatgacattaaactttttataagctcagctgcaccatttccaacacaaatatattccttttttacaccaaaatatttgctcgccaataggctattaactcccattcctgagggatattcagtcaataatgtatcaaaattggctttcatctcctctcgcattttccgagatgggaaatagggatttactaaatagcaaaaatcaagcaaaccaggaaaacgccaataacctccaaaacgtttttgataaagagacaacttaccagaagagtcagcaaaaagagtttcagcaatatccaaatcctgaacatcgtctatttcataccatttttcaccagttaaaggtaacgcttttaagtccgtattatcaagtaaagtaatcacacgcaacacttgctcataatactcattatttccccaagctatagaataagcctcaagaaaaggaacatatttactcctcgaaaactccttgctaaatttgtaaacattgaccgttttatagtatgaacttacatcactatacttgaaagtttttttaggtacaaagtttacaatattattttcctcatccaaatgaaccattgtcccgtccatccacgtttcatatttatcaaccaatgctacattaggatcaggactattcagtatcatatcaaataatgaatcttcaaaaataagatccgattcgatcaataatgtatcatcttcttgaagttgctgtttcgctaatgaaagtgaataaatattatttgtagtattgtatattgaattttcaatatattctatagccagtcctttatactcctgcccaatataatcacgaagcttctttccttcataacctattacaattattactttcaccaatgaaaatctcgacagttgagtcaacaatcgatctataagaggaactccattaactttcaccatacacttagtattgtccttggtcagatctccaagacgtttacccattccggcagccaatataatcgcttgcattctttctaatcttgttagcgggagctgtcaaaagtcttttcactatagaccacacagaagccacagatcatcaaaacagataatcaataacttaaaagtcattctatgttactctgtgtcctctgtagtgagtttcgacacactctcattctttttaaagtttattaattttaatttctatcatcatttggagtagattctcataatcacgacgtcccgatacgtttttattgtcaatacccgccttagagcatatcttgtttatcataataatcaaataaccaggcggcatcttttaaggctgaatgacaagaatccttctctgacaaaatgacttcctccattggtattttccaatcaatacctaaatctggatcatcccaagcaatagctccttcacactgaggagcataaaaattatcgcatttatattgaaaaaccacttcttcacttaaaacagaaaagccatgagcaaagccacggggaataaaaaactgacgatgattatcctctgtcaattcaaccgaaatatgttttccaaatgtgggagagcctttgcggatatcgacagctacatcaagaacagcgcctttcacaacccggaccaacttactttgtgcaaaaggtggtttctgaaaatgcagaccacgaatcactccataactcgacttagattcattatcctggacaaacatcgttttacaaactttctctataaacacattttgattaaaagattcaaagaaataaccgcgttcatcacgaaacaaacgaggttcaataatcacaacactctttatatcagtttctattatattcattattggtctgcagctaattcatcaattactttcaaaaggtactgcccatattggtttttcaacataggctgagccaatttcttcattttatcagaattaatccacccttgacgaagtgcaatgccttccagacatgctattttcaacccttgacgtttctcaatcacttcgataaaggtacttgcttcactcaaagagtcgtgcgtacctgtatccagccaagcaaaaccacgtcctaaaatctgcactttcaattgttcttttttcagaaaatactgattcacagttgtaatttccaactcaccacgggcagaaggttttatgttcttagcaacttccacaaccttattaggataaaaataaagtccaacaacggcataattgcttttaggcactttcggcttttcttcaatggaaagacaattacctcttttatcaaactccgcaaccccataacgctccggatcattcacccaataaccaaacactgttgccttttgcttttcatcagcaacacggactgcctcttttaacatagccgaaaagccattaccatgaaaaatattatcacccaagactaaacatacagaatcatcacctataaattcctctcctataataaatgcctgtgccaagccgtcaggagaaggttgttcagcgtactcaaaacgtactccaaagtcagaaccgtcacccagcaaacgttgaaagccgggtaaatcgtatggagtggagataatcaatatttcacgaatccccgccaacatgagtacagagataggataatagatcatcggcttatcaaatatcggaagcaactgcttactgactcctttggtgatcggatataagcgagtgcccgaaccaccggccaagacaatacctttcatcaatatacttattaaaattaaattactagatcgaaatcattccacctcactccaaggatacggattctcttgtacatccttcaggcgttccatcacctcacgctcctcttccgacaactctctgtcctgccacgtatcgatgatagcctgagcttccctggccaattcctcatcgaaaacctctccgtaacaataaaccagcagttggactttcaacagagaggcaggcagatgttccaatacatcccagcaacgatccagaatatgctgaatacgttcctccttgtcaccgttattatagagagtcgcattatatcccatcaggagcgacagacacaaccgggcctcttcttcatgactattgccatgcttgtcgtacaaggcattagccagagaaaaaacatcacgattcagacgggtgaattgatcactgtagatcggccgaccgtccatgcctaagtagcaaagttcatgggcagaagcataaagagcggagatttctgattctaaatagttcatatcttgttatgttatttttcggtaacaggttcgaccaatgaaggatggacaaaagtggtggcgacagccatgactccttcaatggtgactacgacacgacggtcattgcggacacggacaaactcgccctccaccccctcgaaaagccctccggtgatacgcacacgggtacccttgcggatgttcaactcagaaggttcgaaataaagcagggattcatcataattcgcagagacagccatgaaattacgcatttgagaatcaggaacaatgatgggacgatggtattcacggtccataatgtaacggataggaagcgtggtgcccttgctttctttgatggcatcgatacaactacgcgaggaacggacaaaaaccagattatggaccgcaggaacaagcttacggacccgacgctcgtttttaatggtatattcgtagtgcatgggaatgaaattctctatcccctccgaattgaggtactcctgcaaagccagttcacgcccgtaagtgatacgcaaagcataccagttcaaagcggaagaagacaggagggattgagaacgctccatcgaagattcgatagatacggatgttgtcatgtcgttcacgtcaggatgttctttggggacaccggagtagcgaagcatacctcccggtcaagttatgtaatgcggattttaatgaaaaattcagtgcatccatgttatttaatgaccctccactatcacagaaggagaggcagaaaatagttatttattataatagcctttaaacgagggtattgaaaacaaaaagtgtttcaatagacgttcgtttaaaaacacatgatttttgtatataaatcagaagagaacagaaaacaaaatcagacagataataaactgttttttgttaattcataaatacctgtggtttaagatattgggataacaatcaaaagagaaaaatcattttttttattaaacattttgtagttctaaaaataccccctatctttgcgttcaattaaacgaacgtctattgaaacactcactttttcaattaatatcatactatataacaaatagttatctaatcagaagcgttcattttctctttaattccatctttacttgcctaccgatagattcctttctacctttgcaacaaattaacaacatttaattattaacaaaataaaagaaattatggacaaagaaaaaggattatttcagattgcggacaaaagtgtaaaaaaacgccattaacaaagcacaacaatctaatactgaaatagttaaagaatcaagaggtagaaaagaaggaaaaccaatagaaggaattacttcgcacaaagcagagcttatcagagcgttgatagaatcctacatagaggatgcgaacatacaaaatatcaatacatgtcaggcttcactcgcacgctacatcaatgaaaaaggactaatcggaaatattagaaacggagtatttaaaccactatccatcagttcaatattggtctacatcagcagcatttgggaagaagtggaaaaggatagacagcacaaacccgccatccacaaaaatacgcacaatgaattatcataatccgtcttacatgaaacgccccctatcttcgtggcgataacattttatcaacttaaaaaatatacgtatgaaacggaaaaaaagaccggcatcacaaagtgaagccatgaaactgagatggaagagacggattgtctttgagaaaggatataccgagcagtgtgccgaatggatggcggaacgcctggaagaattaatagaccacttgcaatacgggcacgcagttattgcttatcagaagcagaacggagatttcaggctggtgaaagcgacactgatctactatgaagcggaattccacaagaagtatgatcccacaaaaatagaaggcgcagtagtctactggaatgtggacgaacagcgatggacaacatttcaggtggagaacttcatggagtggagaccgatcgtatagggcgccaccacagattacacggattttcacagatgaatgatttctattttgaggaatcaagtgaaaacgtctttgggaatccggggtaatttgtggtgaatgtattaatgtattattgaaagtacaaacaactaatctaaaaaaacaaatatggcaacaatatatgacgggatcaactatttcccggtgggcgtaaacttcatggaagagaacgcaatggaagtgatagaagctaaatacggaataaagggcccggcaatcgtactgaaactgctgtgtaaaatatacaaggagggatacttcatccgttgggacgaggaacagtgcctgatctttgccaacaaggcaggaagggaggtacaagtcgctgaggtgcaggggatcattgagatcctctttatcaaagggataatggacaaaaacagttatctggaaaacggaatactgacttcggaaagtatacaaaaggtatggatggaggcgacaaagcggagaaagagagagttgtcggaactcccctacctgatggtgaaaccggaaaaggaaaacgataaaccggacaatgcatccacacaacaggaaattgaacgacccaagccgcttaaagaaggaaaagtagctgtcagcacaggagatgtagccgttagcccgggaaatgtagtacacgatgtagccgttaacgcaaaaaatgcatgcaattccggacaaagtaaagtaaagaaaagtagagcaaaggaaaataaagaattacccccctcagctccccccgaggggaaggaggaagaaaggatggaggattctgcttctctcccgataccgggatacgctttcaatacgatgacacacaattatccgggactgacggatacgctccaaagattgggaattaacgaggtaaatgaagtaaacgccattcttaggctgtcggactatggcagaaagggaacgacggtgtggcggctgattgccaacacttgctggagtgacataggggcaaaaggaaggtatctgatagcggcactaaacaaggcgaaaagaagatagcagggagtatgagtccccgatttgtagttgacaaaaaagcaagtatacaggcttttacccaggaagagattcggtgaaacaaagaagtaaagagtgtgcttaacgaactaaaacacagtgtttttaaagcacaagatttctctcgcccaaagctttgttttaacactatgttaaagcttgttctttaaatgcaaatagcaagtgttttaaatgcaaaaggcttgttatttgcacacaagaataaaataacggagaaatggcgttaacaatgttaattgttacgatattattctcagagcaacatgctacataaatccagccttttcatttgcatgtatcataaccctcaatttaccccccaacattgcagcgggaggaatattcaatacccgacaaagcaaacgggctattttttaagtaggctctgaacgtcctgcaatataatcattcacccgtgaaggacttattccaatctcaatggcaagttgcttttagctcattcctttttcttcaagataaaattctattaattctgcaacagttgttttttttatcggataatgttctttttcgtatgcaataactatgtcggacgtgacagagagttctactgcattcttatcattcgcagggatattatcaactaaaggagttcttttataatacagcccccctaagtaacaaagggctgtcaaaactagcatatctccttttgcgacacaaaaccccgactttctcaaatcaaggctttgttatttcccaaagcgtttgtaactttaggcataagtttttcattatagcaaagataccttgcaacatttgctcccgacatttatgacgggaacaaattgtaaattcagctttttcagatgtttacccttacataaaacatatccattagccgataactcatctgaatatttttctaaatactgttccattgtctactcttctattttataaaaatttacaaccattttttagtctatctttttagtttttatgccctgtgacaataacgattctgcttgggataataatatccctattattacatcctaatgactacgagaagcaaatccgattttctaaaccaattatcaaatcatccctctttattttatcgttcagatgcagaacatccccaccctttcatcattactctatttccgatttcctatcttcatcaacgccagcccgataacaatccagaccatctcccgcacccgcgtaatcagagcggcaaataccccatatgctccggacaaagacaaaccggctaccgccagggcaaagcctccttccctaccccctaattgcatgggaagaaagaaaagcagattggccagtagggaagagaaagcgacgatcaggatgcaaccgacaaaactgacatccgtagtcaatacattcagaatcaaccagacttcgagacaccccactatgcgagcggtatactctaaacccaatgccgaataaaaggtacttttgcgctgttgatgaagcaatgctatctgactgtctatggtttccagtttttctttatggagttccgcgaagcggactgcacgattcttcaaaaaagggatatgactacccagacgtacgcatgccacagccataccgttccggtagcctttgataaaaagagtgacaagcaagaggcagaagagtgtggtcaaccccaagacaatgcccatcccccaaccgaccggataaaaaaagacataaatcaacaccgagctgagccagaaacagaaatgcgaaaagatatgcatcatcacatacaggatgaccgaagatgtggcacgctccactccgacgtagggagtaagctccataatccggtaaggttcccctcccatcagtcccacgggagtgacataattcaacgcaaaaccggaaaccgtgaatttatagagccgggcgaacgacaatgaattcaccggaccactgctacgaaggatgatataccacgaaagggtattaatcagatagatgaaaagccaaaggaccagaaccagcggcagataaaatccggcacgccgcaggttatccagcagttcatcataagacacatcgaaagtgaacagcatgatgatgacggccaggatgccaaaggccaaaaacaaattacgaaatttactcttcaaaacaatatacaatttaacgcatcaaagataacgttaataatttatacaatgatataagaatagcccgtttaacaaaacactttcttgcacaagctgtttttaatgagaatttaaacctaaacaaattaactatggattggattattcatcaacttagggttcaccccgagcttgccatctttttgacccttttcgtagggttttggattggcaaaataaaaatcggaaagttcagcctgggtgtcgttacaagcgtattgctggtaggtgtccttgtggggcaattgaacattacggtcgacggccccattaaatctgttttctttttactctttttattcgctatcggctataaagtcggtccgcagtttttccggggactgaaaaaggacggactcccccaaatgggatttgctgccatcatgtgtgtattctgtctgattattccctggatattggctaaaattatgggttacaatgtaggggaagcagccggattactggccggttcacagacgatatcggctgtcataggcgtggcaggagatacgatcaatgaactaaacatatctcctgaaacaaaagaggcttataataatattatcccggtatcatatgccgtaacttacatcttcggtacggcgggttcggcatgggtattgggctctctcggtcccaagttattgggcggactcgataaagtaaaagctgcctgtaaagaattggaggctaaaatggggaatagcgaagcggatcaacccggctttatgcccgctgcacgtccggtgactttccgggcttataaagtagataatgagtggtttggtgacggaaaacgggtatcagatcttgaaagctatttccaggagaatgacaagcacctgtttgtcgaacgtgtcagacaagccggagttatcgtaaaagaaatcaccccgaccctgattctcaggaaaggggatgaggtggtattgagcggtcgccgtgaatatgttatcggcgaggaagattggatcggtcccgaggtactggatcctcagttattggactttccggctgaagtattgcccgtcatggtaacccggaaaacctttgccggagaaaaaataagttcaatacgttcacagaaattcatgcacggtgtcagcatacgccgtatcaaaagggcgggaatcgatataccggtactgccgcaaaccattgtggatgcaggtgatattgtcgaattggtagggaccaaacacgaagtggatgaagctgccaagaaaatgggatacgccgaccgtccaaccaaccagacagatatgattttcgttggtctgggtattctgatcggaggactgataggtgccctgagtatccacatgggtggtgtccccatcagtctcagcaccagtgggggcgcattgatcggaggattgttctttggctggctacggagcaaacatccgactttcggacgtattcccgaacctgctctctggatactggacaacgtaggtctgaacatgtttattgctgtcgtgggcatcgctgcaggtcccagcttcgtacagggattcaaagaagtggggctaagcctgttcattgtaggtgcactggctacttccattcctctgatagtaggcatacttatgggaaagtatctcttcaaattccacccggcactgatattaggatgcacagcaggtgcacgtactactaccgccgcattaggtgccatccaggaagctgttgaaagcgagactcccgctttgggatatacagtgacgtatgctgtgggaaatactctcctgattatctggggagtcgtaattgtgttactcatgtaaaatagattttgatattaactaaacataaccctgacataataatgaaaagtaatgaaaacaacggagcagtaactaaaagttttgctaaaaagatggagagtatcagtcctttcgaactgaaaaacagactgattgaaatggctgatgagagcatcaaaaagatagctcataccatgctgaatgccggacgtggaaacccgaactggattgccaccactccacgtgaagctttcttccttttaggtaaattcggactggaagaatgtcggcacgtgatgtacttgccggaaggaattgccggtatcccgcaaaaagacgggattgccgcccgctttgagacttttctcaaaaccaatcatagccagccgggtgcggaactattaaaaggaacctatcaatacatgttactggaacatgccgccgacccggacactcttgtccacgaatgggcagaaggggtaataggtgaccaatatccggtaccggaccgcatcctccagtttaccgagatgattgtacaagactatctggcacaggaaatgtgcgacagtcgtccgccaaagggcaaatacgatttgttcgccaccgaaggcggtacggcagccatgtgctacgttttcgactctctgcaagaaaacttcctgctcaataaaggagatggaatcgccttgatggtacctgtcttcaccccctatattgaaatccctcaattgagacgctatgaatttaacgttacggaaatatctgcggaccagatgacagcagacgggctgcacacctggcaatacaaagacgaagatatagaccgcctgaaaaacccgcagatcaaagcactcttcattaccaatcccagtaacccacccagttatacactgagtcctgagactgccgcacggattgtagatatcgtgaagaaagacaatccgaacctgatgattatcacagacgatgtatacggtacattcagtccgcatttccgctcgctgatggccgaactgccgcaaaatactttgtgcgtctattccttctccaaatatttcggggctaccggatggcgcgatgccgtaatcgctctgcacgaagagaatatttttgaccggatgatagcccacttaccggaagaacaaaaggcaatcctcaataagcgttactccagcctgacccttgcccccgaaagattaaaattcatcgaccgcatggtagccgacagccggcaagtggcgctcaatcatacagccggattgtctctgccgcaacagacgcagatgagcctcttcgcttctttcgccatactggataaagagaaccggtataaaaacaagatgcaggagatcatccggagacgcctgaaagctctgtgggataataccggattctcactggtggacgatccgctgcgtgtaggatattatagtgagatagatatgctggtgtgggctaagatattctacggagaagagtttgtagactacctcaagaaaacgtacagcccattggatgttgttttccgcctcgccaacgaaacctcattggtattgctgaacggtggcggttttgccggaccggaatggagcgtacgtgtatcacttgccaacctgaatgaaaaggattatgtcaaaataggccagggaatcaaacggatactggatgaatatgcccagagatggcaggaatcacggaaataaaatcctgaatcttgtcagtccgtcagcgtatgtacgcaatgaaaacgtacagccatgacggcttaaaacttcacggataaagaccaggccgataccttgtccgttgggtttggtagaaaagaagggactgaagagctttgcttcagtctcttttgttatgccgggcccattgtccaccacttcgatagcagcaggtgatgaggtgcggatggtaatctgaccgtctttcccgatactttcagccgcatttttaataatattcaccaatacctgctcaaacagggaggcgtccagtttcacatcctccaatgattcatcacatatcagttgtaaccggatattccggtcattgcacatcccctccataaagcgtttgcaactgaatgcaaggtcattcaggttgatcggagtaagacggggatcgggaatcttcaccacgtcggcaaaacgggtaatgaaacggctcatagaaaaacaacgttccgtacagacacgcatcacatcacaaatatcttccataccatccgactcagacaatgcctgttcgactgtatccagtgtagaagtaatccctgccgttgtattattcacttcgtgcgcgatcatacggatcactttctcgtatgcctttttctccgctttcatcacttcgtctgtcaatccttccatcagataaaaaggatgctggaagccgcggtccacaaacgaagaatgagtacatttatagatatttgaatcattcagtcgcacggtgctggtttctcccttcggaatggcagccagttctatggcaagcggcgaatcgatctcggacagtttcctgccttcggcttcttccggacggactcccatcatcttcatcgccatcgggtttagttgggatacctcttcatccagtgtcataatgacaacacccataggtgaagcgttaatcatcagatcaagaaaatgattctgttcacgcaaccggagacgctcgttttttagttgatccatcatacggttgaacacattcactacccgatcggcttcctgttgaccgacgtggctcaggcggctgctgaaatcctgttctctcaaaagttccataccactgccaatcgtattcattggtttcactatcttccggtaaaacaaaatcagatataaaacgaggaacagcatcaacccttctgcgatatagagatatttcgccacaatggtttcggatacatagaacagaaagcccatgatggaaaacaacagaaagataagtatgaagaaaaatccttttaccggcatgtgattgatgattaacgattaaaaagtaatgataagcgacgagtcacttatcactgatatcatatttctccaaacgacggtacaatgccgcacggctgatacctaacgctgtagccacctggctcaggttccctttataacgctccaatgcctgaagaattgtctgtctttcgatttcatcgagtgtcattcccgcaaacgaagaggcagttgacgtactttcatcatgtcgctggtactgactctcgaaatcggttgcatccaacacttccttgccactgaccagaatcgtacgctccaccagatttttcaactcacggatattgcccggaaaaggcaaacgactcaggaagttcaatgcatccgacgaaaactccgtacggggtaggttgttgatctcagcctgacgatcggcaaagtgtctggcgagtaacggtatatcctctctgcgctctctcaacgcaggaagttttatggttatcaggttaatgcgatagaacagatcttcacggaaagtgtgttcgcttaccatcttggccaagtcggcattggtagccgaaacaacccgtatatccgtcttacgcggacggctgtcacccagtacttcaaaagtctggtcctgcaatacccgcaacagtttcacctggcatgagggatcgagatcgccgatttcatccagaaaaatagttcctttattcgccatctcaaaacgccccatacgatcggaagtggcatctgtgaaggctccttttttatgaccgaacatctcactttcaaacagactctgggatattcctccaagattgactttcacaaaaggctgacgggcacgctgactattgatgtggatagcctcggctatcagttctttaccggttccgctctcaccggtgatcaataccgaagcattggttcgtgcaatacgagccaccgtattcaacacctctgtcaatccacggctcttgccaataatatggctccggttcaatgaaccgctttgctcctgaagcgtatccttcggagttgcagtaagctccaaagcagtctctatgcgttgcagcaatgcggcattattccagggcttggtgataaaatcgaatgcaccggcttgcattccctgtacggcaagttggatactaccccatgcagtcatcagaattacaggaacatcgggacgaaatatcttgacctgcttaagaagggtcaatccctcttctccggaagtggaaagtgtaaaattcatatccatcaaaatcagagaaggagcttccgaacggactacttccatcgcctcacgcggaccgggtacagttaccacttggtaaccggcacgtttcagcatgaaactcaacgaggaacgaactccactatcatcatctataattaaaagcataagtgttatttttttgatttgcaaaactactctttttggggttaaaaccaaactaattcttcacaacatcatcaaaatcggcttccagtggtgtattattctggaagtcccacagcgtcagactgcggagctgataaaaataataccagtaccagtagagttcattgatatgtttctgccgggcatcatctttcgaattctgggcatcattcaggtcgagtgtattgattttacctatcaggaaagtctcgatactggttttataacgctgctgtgcaatcttatccgcttcattggcaatagaaagttgctgtgcctgattattaaaattctctacaagcaggaagatgtcctgatcaaagtcaatttgttctttacgtattttggataaggtaacttcccggttactcttggctacacgcacttttccacgacgctttccccaatcaagaatcggaatcttcacaccgacctctaccacttggttatcgagtaatttttgataagaagcagagaaatccttattcagtccggtatatcccacgtttgcgaaaagatcgatactacgaagattgccacgtgcggtagccacttcgtaatcagcttccaactgccggcgacgtatgttatgagcgaaagaattgcgctccaatgctttattcagcactttgttgtattccattttaagatcgggtgctgattccggtattaccggctccaatacctgatcatctcctattgccaggaaagagcgcagccggaacatatttgcattcagattgctctgtgcatcggtaacggcagcccgagctttcaatgcagccagtttcaattgcaaaagctcattttcggaaatttgccccatctttcgtttcgctccggccacctcgtacaagcgatctgcatttatctgattctggcgggcggttcccagagtttctttagccagcagaagattaaagaagtaagtgatcgcgttcatggttacagtctctgtagcagtgataaaggctgcttttgcctcttcataacgaaccggctcaatgcggcgattccatttcaggtcattcactccaaagataggttgagtcaattgtaaagcgataggcacggacataaactgccggtttccaccactccccagctgtttcacaaagtcgagtgaagaagacagggctatcttaccacccgtaaaccagatattctgatcaatggaaagcgtaccgttcagccctaacttattactgcggacaaaggagtaagagccgtcttcattctgataactgttatattgttttccatagcttggcaaagtcccgctgaaatttacttccggcaacaaatcggcacggaacgtacggtattcccaataagctgtcttcaactcattgagagcaacggctgcatctacagactgtgtacgcgccaatgcaatggcttcattcaaggtaatctcccgtgtttcctgtgcactcaatgccaacgaacagaaggcaaaagcagagagtagaaaagatcgtttcatatagaatttgtttatttaccggcagaaaagcaaaccctgtgccaaatattgagtgttgcagcgatcactccaactcgctatataacataaacattcatttgaaagagttcagtgtatgataatcctcactccacttccctcttggtcactcttcacctgttcgtcatccaccactccttttgttcatccttcaccgtttatcgttcaccgtctaaaatcaatcccccttcttctgtccgaaaatgaacagtttgtccgcagacggacgcccccggtgtacttattcacaagtatccggtaaacgaactgtgaaacgggttccctttccttccttcgaagtaaccgtgatgactccattcaaacgtccgatgatggtttgacaaatactcagtcccaacccggctccttgggtaaaactgtcgactttatagaaacgttcgaagatatgcctcagcccatcttccgaaataccttttccggtatcttctacaaaaatagaagtatatcccggctcttcctccgtataaccgaatgtgatcgacccttgtgttgtaaacttggcagcattgtttatcaggttattcaccacttgttgcaagcggacattatccgtcaccagatattttttactattctccggcaacttcaataccaaccggactccggaaggcatgttcaactgttgtgaatcgtatacattcttcatcaataacggaagattgtgcccggcaaactggaaatccatcgtaccggactctatacgggacaaatcgagaatatcattaataagtgccagtaacaggccacagtttttattgattgtctcaataaacaactttacctcctcttcggtaaatccactggtatcactcaacaaatcggagaagcccacgatggcattcagcggtgtacgtatttcgtgactcatattagcaaggaatgccgatttaagcttatctgcctgaagtgctttatcgcgggctgcggttaattgctcttcggtagtcttatagcgctgtatactctgacatacgcccagaatgctgtaaggtgtgtctgtcgtaagtcctgcaagcaccgaagtacgatattcccaccattcgtatctgccgtcaccgctaagctggcggaaactcatacgggtactttggctcagacctgccaatgcacggttaaagagttcgaacgccaactcctgatcgtccggatgaaccatccggtccatctcattccatgaaatggtggtcttgttctctgcaaacccgaagcgtaccagaaagcccgcaggaaaagtaaataaaccggtacggatattatactgccagggatagatggagctttcgtccaccgccatactaaagaaacgtttttgcatctcttcatccgatatattacgggccgaaagggccattccggtgattttaccatgtgcccggataggaacgatctcaccggaaacaggaaaataactgccactgtggacttcctgcataaacgaattttcgggaatgaccacactgccctcttcagttaccacccgctcgagcatggaacggagaatctctttaccattattgtaaatcttgaagatactgcctgccggtaatccttcataaggacgcgcggcttcatccttaggcaaatgcagcattttcagtaaagaacgattcgtaaaatgaatacggagatcggtatcgtacgtgatcacaccgtcacggattgaatggaatacattatcgaattcatcacgttgggcaaccaaccggttttgtatcagtaaacgggtctgggcatggatgcgccgacgggattcgcggcggttgatgcgatacagccacactatcaaaaacaccagtaaagctaatatcgagctatacagtaagatatagagcaaacgatatttctctccgtatggttcgttgataatggttcctccaatagcctgcacctgcttgggatttaccttgaaaaataccagctgcttgaaatcatacataaaattcaagggagattcaataatgcccacttccgaaggagtcttcccacgtaacacatcggaagctgtccgccccacctcacgtgcagaagtatatgaatcggcatcataagccccgaaggcgccattagtcaatgcaagattttcacacgaaaagaaaggagcttttgaattacgtccgatgaatgacataaaaggcgaccatttaggggcaataatcagtgttttgtgcgtattgcgcggataacatgtggaagctatgattttgttggttgtatccgtttgcgaattatagaaagttaccgtatattccggatgctctttcacaaagccattccattcgttcataaagtcgtctcttcctttagaactcagaaggctgttgtcagagatacagactacttccgtccgactcgggaaaaggcggttcgcctgcctcaacagctccccgaaatccggatttgccgtatatccacacacattgggtaacgaatcgatcagactgccttccggatattttatattaaaaaagacaacaggcaactgtaaaggcaatgaatccccgcaagtcaacaaagtatggaaagcctcgtcactgacagtaacaatcaaatctgttccccgttcgcgggctcgttcgcagaaacgccgcataataagtttctctgactgataagtccagaaattggcatccagaaattctgttgtcacattcactttcagtccggattcgctgaatccttctttcaatcccttggccaaatcgccatgccaaggtgtttcggaagcatacgactgaatgaaaagaacattataaatacgttccgcagcagtggatatttctgtgagaaataaaaagatagatataagaaatatagtatacgatcgtctgttcatagtaaaaaaactgcgttgtatcaggattatggacgcaaatatacgttataatcttgaaaacaacgcagatagattacgatttattgcaataagcttttattcctcacgcagtgcttctgccggctggattttcatggactgacgggccgggaaccaaatgccggccaatatcatcaatgccatcaacagcagagtaacacattcgcacaacacaaaacgcccgacagtgaacgtggagaattgccacgaaggtgtcagttcgcttttggcaatataacagtcaatgcccagtgccaacggagtgaccagaagcagcatgaaccagccttcactgagcaaacggaaaaagacactcttcttgctgccgcctaccgccatcattaaagccatctctcctttacgctgctgcgtccggaaccagaaagtgcccaacaatcccaggaagatattaagcagcaaaaagcccatccccaccaaatagtttcgtaaagtattcatatcgtctaactggaaagtacgacgaatattctggaatgaatttactttcgataaaaagacattccccactctgtattgggatggtgcgtctttcattaaccgttcggcgaatccggcaggttcaccatcactggtacgcagacagatttcattgccatatgctaattgatcctcccgcattaaaatgactaccgaccaactgtagcaagcaggtgaaaaatcatcgtaacgaatcacttcaagtgcggctgataactttgtaccgcgaaccgtatcctgatccaaataaaaatctttgccaatataatctttcaagtctatatgataacgggattcaaaaagattacgcgatgccataaaagcaccctctttcagcaaagttcccaattgttccggtgtttctccgttagctccccgataacggaatacacggaaaaagtcaggggttacccaccgccggatattatattttctttccatcgtatccaaacgtaccgtcataccactgttgctgccattgtaaggaaaagaattttgtgacatactgactgcctctactccgggacgacgacgcaaacgatctaacaactcacgtatatcggcattattttcctcttccgtgcgaccggatatataatcggggcttttttccgtaagataatcaaattcaaccctgtaagtattctctgtatcaaagccgcgaggctctgaataattatacaaatggacaaacatatagtcgaccacataccaaagtataatacttactaacagtaactctacgaacaaccacgcattcgaacgccgttcattcactatttgttttaataatttcttattcatcgttcatgtagtgtttaattgagttttccgccaagagcgtttatgatcgacattcgggatgcccgccaagccggccacccgctactgagcaagtttagcagcaggcaaaagagcagagcataaataaatgtagagagtttgaaaagcatcttccactcaatgaccggagccgtattgagatgcatcagctgtgaatcggcaaagagcgtaccgccccacacataggagatcagcaaacagaacaataatcctacaacacccgccatcaaagtcaataccaaattctcggcaacaatctgtcccatcacccctccgcgggtagcgccgaacgaacggcgcacgccaatctccgccacacgctgtcgcaggcggctgtgagtcatcgaactcaggttaatggcaggaaccaacaacaaaataaggaaaatgatcacttgttggcgaaaataacccgccatatccggttgcacatttgcccatatacgctgtgacatggtcaactggtcatccggctgtccccggtaaaacacaaaataatctcccaatccggcattgtatgccaaacgacgtcgttcacactctgcccgaatcgcatcaaaatcagaagagttatgagccagaatcacaacctgcatcactcccatgataccatcattccatacattatcccctcctgtgatgttagttgacagatatgggacccatatctgtgcataggccgtcgaagccattgaagagacatctttcacaactccactcacccggtaaggggcatcgttcacaaaaatctctttcccggccacatttgtagcagtaccgaaaagaagccgggccacactttctgttataacagccacgggcaaacccgatttagcttcagcatccgagtaaggcttgccatcgataaacgagaagtcgaatatacgccagaaagccccgtctgtctcaagtgcatccactcctgtacgcactccccgagacaaagagacctgcatcgtctcggggatgctatatatactaatttcttcaggagtttttaatccttcgaaacatcccttcgccgtttttattcccatcggaccgttacttgatccgtcgtcactccaggttttgttgcctacactcatccatttgacgtgcaacaagcggttccggttactttcgggggcaaaaggaaccgtctttatctgttgttgcatcaccactaccataatcaggcaaatggtcagtgcagtgcccagcacacttatcgtagtcaacaatggttgttgcttaagttgcgacagggcctgcttgaaatattgtttaatcattgtgttctctttattctcctactttcaatccgcgtgtattaacccctccgactccacctttagaaatatcagctttacgggctttacctttcagggtcatgcttcctacaccgtcggcacgagctgtcagttcatcacaatccacccggatattgacactgcctacaccatccaaccgtactttgagggtttcacaaaccaaatcactaatttcagcaccgcctactcccgaaagagttatcttcaattgatccaaccgaagtgcggtccggcaattgaagctgcctactccctgcaattttacactcttcagatcaggagcggcaatatacagtttaacatttttggaattgctgttattctctttatatccaatcatcaaagtctctttttccactttcgttgtagtttcggatacatatctctgcgggccctctatccgaacagaacaacgatcggactgcgtaaaaatgatatctccgactgcatccagacggatagaagaaaaaccgggaactttacggttatcaacaatgattcccttacttccggtagttttaccacattggcaatcatcactgcattgagcctgtatcatattgaaagttgcccccattgtgagagctaaagccactaacattactcttattttcatcgtttcctaattttgagatgaatgactgtattatgattattattgtacttgccgtccgtcaaagaaccgaatggtgcgtgaagtctgtttggcctgctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttgccgtccgtcaaagaaccgaatggtgcgtgaagtctgtttggcctgctcctcgttatgggtcaccatcacaatggtacgtccgtcttctttatttaaccggtgaagcaactccattacctcagcccccatcttggagtccagatttccggtaggttcatcagcaaggataatctccggattgccgataatggcacgggcaatggccacgcgctgacactgaccaccggaaagttgagtggggaaatgccgcatacggtgagtcaaaccgactttctcaagcacctcctgagccagtttccgacgttcggaagagcccatacggcgatacagtaacggaagctccacattatccagtacattcagggaattaatcaggtgaaacgactggaatacgaacccaagtgtcttattacggaaagctgccagttccttatctttcatgccttcagtgtgtgtaccgtttatctctatggttccggtagtaggtgcatccagcaaccccataatattcagcaaagtcgatttaccacaaccggaaggtcccattatgctcaggaactcaccacggtctactgtcaggttcacattttcaagagccactgtttcgatttcgttcgtacggtagattttcgagagagaagtcaatgtaatcataaacttatggttttaaattatttctttttattaagatcatgttcaaatgacatgccaaagaattaatacacttataaacaaccacttgatatttgggcagagtgtccgataatgaacactctgcccacaaatgaactctctttcttatcaaaaatgaacgtttattcctcgtgtaatgcttctgaattattgcacttgccgtccgtcaaagaaccgaatggtgcgtgaagtctgtttggcctgctcctcgttatgggtcaccatcacaatggtacgtccgtcttctttatttaaccgatgaagcaactccattacctcagcccccatcttggagtccaggttaccggtaggctcatcagcaaggataatctccggattaccgataatggcacgggcaatggctacgcgctggcactgaccaccggaaagctgtgtggggaaatgccgcatacggtgagtcaaaccgactttctcaagcacctcctgagccagtttccgacgttcggaagagcctatacgacgatataataatggaagctctacattgtccaatacattaagagaattgatcagatggaatgactggaacacaaaaccaagcgttttattacggaaggcagccagttctttatccttcatcccttccgtgtgcgtgccgtttatttcgattgttccggttgtaggcgcatccagcaaccccataatattcaatagagtcgatttgccacaaccggaaggtcccattatgctaagaaattcaccgcgatccactttcaggttcacattctcgagagctactgtctcaatctcgtttgtacgatagatttttgagagggaagttaatgtaatcataactttaatttatttagatgattcgttttgttccattttggcttatatgaataagacatgtcaaatggtatgccaaaagaataacatcctcataaattgcacattaaactaatagaaggatgtccgataatgaacatactgcccgctaacgaactgcctgatttacttatcctccggaacaatctcatttaagcaagccaatgcattgagtgtacgcggataaccaatgtagggcaacaattgagtaatgacagtcagcaacacagatttatcattgccaacatttatattgccttgaatatggcctttgacctgcgcctcgcagcccccaagtgacacaaggatggcaaaagttaacatttcacgcgtttttacatccagaaccggacgcgtttgataatcaccgaaacagttggcggaaagatattcctgaaaatgcaattgtccttggggtgcggtttcatacattttgtctattcgttcgccaaaaatggatttctgcaaagcaagtcccttctccatacggttttcggaagttatcaccgcctgtggttccaaaggcaacttcactccttttgacgacaagaatccattggctatagaaatcaattccgcaacctttgccatacccacataaggaacggcatgataaagcacttcttttatttcaagcggggtaactccgttgacaaaagcggcttggagtgttttttgatactctcccgcagtactcatggcaatggtggaagccattgtaaccaaaatccgcatacgagtatccaaatcaccatattgctgtgtttcgccaaaagcaaaattagtgaatatttcctccagttcgggatcggtctgtgcaaggttgtttccgagattgataaacctcgtcgtgccattgcgggaaacactcgttgcagctatcccttggggggaagttgcctcagcgtatgcctgatcatctacaggttccaaccaagtattttggttggtttcaggattacattcgatggccagatgcgaaaaccaactgtcaggggcggctccatgccaatgcactacatccggagctatctccactacatctccgggcagtaacagacgggcatttttccctttttcctgataataccctcttcctccgacagctatcaggatttgtccgcccgtatggctgtgccaattgttacggcatccgggttcgaaagtcacattgctgacaggacaattcaattcatcattctgtgtcaagcgcgccagataggactgccctataaaaaacttcgcatattgcacgtttgcatctcctatgggaaacacactcggattttgtagaacttcttcttttttcatattctgtgcatttaaagaatttgtggtatagcacagcaacgttatcattgccgatgcccatataaaatgtttcattttcataagattataaatttatgatgcaaatttaggcacctttccgttctcatcgtatacccggattacggatgtaattacctcaattacggatattcttacccctattccggttttattcctccaacccatactacatatgatgaaaatccctacatttgtcacagataaataacaatatgccctatggaagaagtaattaagctcaattcggtagaccagtataaccagatgtacggtctcgaaacattgcaccctttggtgacagtagtcgacttgtcgaaagccacgttgtttcccacacacttcaccctcaattacggactgtacgctttgtttctgaaacaaacaaagtgcggcgatctacgctacggacggcagatgtatgactatcaggaaggcacagtaacaagttttgcccccggacaggtagtagaggtaaaggtgactgacgggatacgtccgaagtcacacggtatattatttcatcccgacctgatacgcggcacatctctgggacaggaaatcaaacagtattcattcttttcatacgcttcaaatgaagcccttcatctttcggacgaagagaaaaagatctttcaggattgcctggataaagtccagttagaattatcacgtccgatagacaagcacagcaaacgcctgatttcaagaaatatcgaattattattggactattgcatgcgtttctatgaacggcagttcgtcacacgttcaaaagtgaacaaggacgtactggtgaagttcgaagaactattggatctctacttccaaagtgagcagtcgcaaaccgaaggattacccacagtgaaatattttgcagataaggtaaacttgtcttccaactatttcggcgacctggttaaaaaagaaacgggtaagactgctcaggaatacatccagggtaaaataataaatgtagccaaagaaaagatattggcttcagaaaaaacagtcagtgagattgcatatgaactgggattccaatacccacaacatttcacacgcatatttaaaaagaatgttggctgtaccccgacagaatacaggataattcaagtatgatggcctcttccggtaaagaaacattagatatcaaaacggtgcatcaatgcaaccgctgcctgggatgcaagacgctgcatccacaggcaagcattatccgtctggaccatacgaatgtggaacagcacagcattaaattcgatttttacacaatactgttgatggagaacgacatagaggattgctgttgttgcggacgcaaagcttatgactattccaatgcgacaatggttttcctccctccggaacaaaccttcgacatccacaaaaacagagtactcccacagcagggatggttactggctttccatcccgatctgctttatggtaccacacttgaaaaaaacattcaagaatatactttctttttctaccggaaagaagaggctttacatctgtcccaacgcgaaaaggataagattatagaatgcctacgggaaatggacgaggaattacatcacccgatagaccgccatagccaaacactgatttcacgatacatcgaactattgttggattattgtacccggttctacgaacggcagtttatcaccagggagaacaagaataaagtgctgctcgacaaaacggaccgtttattggatgattatatttattccggtaagctaaagtgggaaggtccgcctacctccgcatattgtgctgaaaatttaaagctctccgttgcctattttaaagatttactcacgtttgaaaccggtaaaaccttactggagttcttccagttaaaaagaatggaaaccgcaaagagaatgctacttgataaagagaatacaatcaaagcaatagccggtcaactgggattttctaacacgcagttattctgcttgtttttcaagaaaatcacgggagtaacgcccaacgaatacagatattcgcagaactgatatttaaaaaagttatataccgtccaaagttttttgaaaatcatgtaaatgtgtcaaaactcaccacagagaacacagaggaaaatttaagtcactgctgatcaatataaataatctgtgttacttcatgtctcctctgtggtggaggtatttgccgaccaatccggttactcgtcccgcaaagcatccgcaggattcatccgtgctgcttttgaaaccggaatataagttgccacaaacgaaactcccagaatcagaacatacgaaataaccgatacaataaggaagtgcaacaccggacgattctgtatataatccgggttcggattatccggcgggaaagcaaagccattcaaatatactatttgaagttgtaccaatgctcctactacaaatgcgatagtcaccatccaccaagcttcaaaaagaaactgccggatcaaccggtgacggttagaccccattgccatatagagccctatttcctcccggcgggcattgcaacgcagccaaaaggtaccccccatccccaaaaagacacacaacagaaaaaataaagcgagaatggtctgcaaccggatagtccccgtagttcccatataatactcaaaatttttactttccgtcctgaaatccgtaagcgatgccagataatagttcccgatctgcattcggggacgcatttcacgtttaaatgtctcagtgaaaacaggtgaagcgagtccatcacgcacccggaaacaaatccgcactctgcccggaagatgtttcaattcagaagtagtcttgaatatcagaggaccgggttggttattacttcttatctgtacggggtcgattatagcggtcaacggaaacttacgggtcgtatctccccaatgcacccatttattttgcggatatttctcgccgaacaacttctctgcgagatcaggagtcaggtagatcccctgttctccttccgcaagtaccggaggaatttgtcctgtccgtgcatcgtgtatacgaaaaactccaaaatagtcggttccggaaaggaaggtcatctgctgtgaatatgcaaggatcgtatcattgaaaacctgtcctccgttccagcccccgctttgcggataagaattaaaaaggctgacagtcacattagaaacacccggatagcggcgtatctgatctacgatgcgcataaagtcaatacgtttcagcgaatcggaagccatctccggtttatatttggtatggttagttgaatattcacctatactgagcaggtaagtatcggtaagatcataatgatcgggcaatgccttatcggataataatacgtacacagggtcgactactccccataaaaaataagtcacaaccaccagttctcccagaatccatccattggcagcacgctggttccacaactggcggagtatcatcatcaggttcatatcttttatcttttttcgttaagcgaatatacaatatctttcttcaaagcatgtaaagccggaatcagagccgacaatacattcagcaccaagctgaccatgaaggtaatacctatcaccaccggattcagcaacataccgggagtcaagaagctatcgactccctcgggcatcacatctaccgagaaagacaacaggtccggaagccagttccgaccacaatagacaatcagatacgaaagtaacaaaccgaacagacctccgatgccagtaagaaacagattttcccaaaatacctgcaacagaagcgaagttttggaagcaccgaaagccttacgtatgcccaattcggaaagctggcgcttcatacgtgaagcaatcattcctgccagattcagtgccggaacaaataataaagctaacaggatagtgccatacactcgtaacagctctccccagtcgggtgccgaattagaatattcataaaaaatacttttccagtaagataccggttgcccatgtaaatcgacactgtattttttctgagaataattatatttgcggaacacgtcacgtacctctgtaattaccttatctttagcatcgacagaaggagccaacatatagacattcagatcacctaccaactcatagccacccttattatcctttataatatcggaatcaaccgtcagtggtaaccaaatatccgcatacgtagcaggggtaatgaaggaaacatcttttacaactccacatactctatattcatcggaatcaagaacaaaagtacgacctaccggtggagtctctccaaaaagctggcgagccattgtacgcgaaatgacagcttttcgtaatccggaatcaaaatcggcctgactaaacggcttgccgtctacaaaggcaaattgaaacaccttccagaacccggcatctaccagcttcacctgtacctctttcaaatctccgtcaccaggcagttcaagtaatgatgtactgcgcccatccatagatgcccctacagcctcggtactcttcagcggataataaaaacgcttcactgcctgaaaggatacgtgcgaactgaaccaattctcctggtttttctgctctacaacagtcattcctttactgaccaggatacggttccggttctcttcgggatagaccggagccatcttgatgtaacagatgatcaccaggctcatggtcatggcaatccccagtcctgtaccgagtatgtacacactgctgaataaaggattctgtttcaggagttgccaggcctgtttgaagtataataccatcatagcaatttattttatttattggttattcgtcccgcaaagcatccaccggattgatgcggctgagtttgtgtgccggcatccagattccgatagaaacaacaatcaacagcaaaaggtatacaatcagggaaacagccgcaaaatgcagaccgaaatggttaatccaataaacaggcatcgtctcttccgaaccgatacaggtagtatagagaccatccttcaacgcatattgcaaatagagcaagcagcctatcaacgtccccaatgtggtcagcacccaaccttcgtataaaagcaggcgggtgatatgtgaaggattaccgccaaaagaaagcatgatgcccacctcttcacggcgcgaacgggtctgcatccagaaagttccggccactcccaaacaaaggttcactaaaaagaatatacctaaagccaggttcaggcgatactggttagtgataccttcagaaaactcatgttgatcctgaatgctgctgaagggccgtacagacttcacataatagttgcctaccgtcagtcctttatccatccactcacggaagtgatgcagaaaagccttctccgacagattgtcgtctatacgaaaagcgattaacggaagataatagtacatataatcaggaaactcttcaaacacgcataactctatgggcatgggttgcatataactccggtaacgaagaggggcgatcactcctcccacccgatagtcttcatcatctccattttcccccaaacgacgtccgtaaagcggttttccatccttcagccgatacgctacgtccgcagtcaataccgattcggtccaacggaagtcacggttatccaattgttcggccgtcataccttcggctccctccatccccatggtccggaaataatcggtgtggggcatgaaagtaagacggagagtgcggaccggaatggtatcgaacatcgtattaccgttactcgtggaattcgatgaaggatattggccattcaagatgaaagtagtatactttactccttcataatgtttcaacttgtcgagcaaccgctcaaaattggctttacgcgccaatgtatcattctcttcgatatggaattgctccgattcggcagggaacgatgccaactgaagcaagaaaagatgatcgggacgatagccctccggcagattccgatcgtgtgtcaacactaccaacggatcgacaatcacccacgtgacgatcgataccaatatcaattcggccaacagccatccgtttttccgacgacgggcccagaggttctttattataagtcgtatcatgatttatttcttagtgttaagtgagtcaataatatcgttgtgcaacgagcgccatgtgggccaccaggcagagagcaggttcagtatcaaacaaaaagcaaacgttacgcaaaacattaaaggactgaacagcatttgcggattgatagccacatcgactccgtcggacacaactgtcggatatttgtcgaacaggctaaatacccaattacgccctaacacaagcagcccccatgaaacaataagtcccatcagcccgccgatgcaagtaagaagcagattttcccataacacttgattcaataattgtttccggttggccccgaacgcttttcgtatccccatttccgccagacgatcgtccatgcgactggatatcatcccactcaaattaatagcaggcactaacaacaaagccaaaagagctcctccatacagtttaatgaccgacatccaatcaatctcgttcgtattgccctctctgaaccacgtctgccaatacggatccggctgatgaaaaatatcaactgtatattctttctgggaaatattgtatttatgcaccatttcattgacctccgcatacagtttcggcatatcttctttctggcgaaccttaaaataaacgatataggtaccgactttatgactgccatcattgttactgtcatatcccggcaagcaagaatagggcatatagatttgcccgtaagatgccggcaacagataactgccctcacgtaccactccgacgactttagactctttgaaatccagtttaaacgtttgcccaaccacatcggtcctgccgaaaatgcggcgggccatccggtcagaaagtactacattacggattccactggctaaatccgcttccgaaaaaggcttcccgttcaaaaattcaaactcaaataaccgaaaaaaattaggatcggtatactttaccaaagccggtatctgctcaccttccccggccggttgtatataagccccctcccggttcagaaagtgttcgtttacagcggtaaccagctccgctgatttcagtgggtagaaccactctttcagcatttcataagaacagagatatgaatttccgcctcctttcacatgcatggcactcacccctttcatccgcatcgtcaccgaacggttcacttccggataaataggagctattttaatataatacacaatggcaataatcatcgtcatggcaatggcaagccccgtacccagtacatacagactgctgaacaacttgttctgacggatcaacatccacgattgttttaaataaagttttatcatagtatgtaattttaatagttattcatcacgcaaagcatctaccggattgatgcggctaatcttccgggcaggtatccaaatgccgactgaaacgacaatcagcaacaagatgtacaccatcagggaagttgccaggaagtgccaaccgaaatgattgatccaataagcaggcgaagccacttcgggtgaccatgatccccaatttgtggagtatagtccttctttcaaggcatattgcaaataaacaaggcatcccaacagcgttccgattgttgtcagtacccatccttcacccagcagcatccgaacaatgttttgcggccgggctccgaatgaaagcataatgccgacttcctcccgccgtgtacgggtttgcagccagaacgttccggccacccccagacagagattgatcagaaagaacaagcccaaagttatatttttacggtatgtatcggtagtaccggcactgaactccgactgtttacgcaaatcggtatacgactgcaccgaattcacatatatatttccggctttcaactccttccccgtccaagggatgaagtgatgcaaaaacacctcttcggaaagacgatccccgattcggaaaacaatctggggcaaatccgaataataccgttcgggcataaccgacaggggattcagacggaccggctgaggttgcatatagcttcgatagcgaaaaggttttatcacacccgccacccgatattcggcagtgctgtcgttgttccatgtcgtccgcccggtgagaggactctccggatgcaaaaagaactccgacgtattggctgtcagcacatattcatctttatcaaagatacgttcgtccagctctccggccgtcatcccctcagctccttcaaaccccatggtccggaagaagtccgaacggttcaggaaagagatctgccatgccgacatataggtagaatctcccttaaacgtctggggagaagtggtactgctaccggaataaggcattatacgattgaaaaaaaacgtagcagactccacaccttcataattcttcacctgttgaaaaatgcggcccaggttttccctgcgggacaggctgtcgtcttcttcgggacgaaacttcccggatttctccggcaaagtcgccaattcaagaacaaacaaatgatcggaacgaaagccctcaggtaacgtacggtcatgggtaagcacgaccaaagggtccgctattttccaagagacaatacaaaccaatacaatctcggccaatagccacaggttgcgactgcggcgcgcccacaagtttttcagtattaattgattcatggctatttatatcttttcgttgatggaatatatgatgtttttacgcagtgaataccatgcgggacaaaaagccgaaagcaggttgagcaatacacacgtaccgaacgcaaggacaaacacaaacggactgaacaacatatccggacttagattaacctccactccttcggggatgggtaccggccacgaattgaacaaaccgaaaatccaattacgccccaacaccagacctccccatgacaacagcagaccgataaaaccgcctacacaggtgagcgccagattctcccaaagcacctgtcctaacaataccgaacgattggctccgaaggctttgcgtatccccatctcggaaagacgttgttccatccggctggaaatcatcccgcccaggttgatggccggaacaaacaggaaagcaagcaacagccaaccatgtattttgaatacgttcgcccagtcaatctccgaataccccatttgtttaagaggatactgccaataaggaagaggctgattgttcaagtctatttccagatcgggctgagagtggttgaatttatgaaccaactcctgtatttcagcacgtagcttcggggcatcatccgccccaggcagtttgataaacacctgataaggacctaccatattggccattttatccccccgatcataaccggttatacaagtatagggcatatacacgtcggcataagagtcgctgagcatataactgccgctacgcaccacgcccactacccgatagtcttcaaaattcagcgagaacgtacgtcccaccgcttctgtgtcacccaatatccggcgggcaccactctccgagagcactacattgtggattccgctttcaaaatcggcctgtgagaaagcctgtccgcccaggaattcaaacgggaacacccggaagaatgcaggatcggtctgtttcaccattacgggaattacattcccaccatcttcgggctgtacataatttcccaataacatacgtcccaaaacggccgtcacttcttccgcgtttttcaacggatagatccattctttcagcatatgataagaacaggaggacttggtcatagaatgttgctcggtgttttttacggctaccgacgtcaacaccatcgtctgagaccggttcgtttcgggatagataggggcgatctttacataatacacaatgacaataatcattgtcatggcaatggccagccctgtgcccagcacatagagactgctgaacagtttattctggcggatcaacgcccacgattgtttgaaatagagttttatcatgtctgttcggtactaaatttattattcataatgcagcgcttccgccggctgcaacttcatggcccgacgggcaggcaaccacgtgcccaacgcaatgatcagccccatcagcaacagtaccccaccaaaaccgacagcaaaacgccaccaggagaaaggaagattgtacaaatcgggaatttccatgtgtatcatattgaacatgacaaacagcaccagcggagttacggtggtcagcaataaccacccctcggcagtgaagaaccatcctacccgcctgcgtgtactgcccagtgccatccgcagaccggtttcactacgccgttgctcgatgcgtagccaaaaagttcccgtaatgccgaaaagcacgttcagcaagatgaaaacggacaacagaaggttaatgctgattttccgccattcagactgcaatcgttcactgcgttgttgcttcatatccttcatgctggcaacgtagagattattctccgtcaactggctcttcatccggtttaggaaagtccccatctgttccggagtcaaatcttctttcatccgcacggttatctccatattagctaccccggaagcattcacctgacgttccagctctttcggtctcatagtaaagaaaagttcgggctccggcttcacaaactcggtcatacgaaccgggacggtcactgccgcaatgcgtatctcccgcatactactgccgggataacatactttctgtcctactgccgactcctcaccgaagaaatctttttccagatccggagtaataaaatattccaactgttttttgttcaataattcactcagaagctgtccctcacggctccggatacgaaatacatcataaaattcgggagaaacggtatattggtgataggattgctctttgaacttaccgctatcggccgtacaaggcatgatctgtgtccatgaattacctccggaatagggtgaggaatagaaagcaacacaagcattatccacttccggggcacgacgcaggcgttcaaggatccgggccaatgcttcaccttcggtaggagcctgagtagtgtcgctgacatactcggcggcatcttcgggataaacatcaaacgaaagccgccagcaattcgtgatatcatagcccaacggacgggaataggaatagaactgtaccacaaacatatctaccagataccacagcgcaacgaatacgaccagaagttccatccatatccaaccgttagagcggcgttggttccatattatcttaaatatttgctttatcataacgggtctttgtttttaaaattattccatatcatgcaacgcctctgtaataggcatccgtgaggcccgccaggcggggatcgcggcactcagcaaattcagtaacagcgtgaaaaagaaagccgcaacaaaagtgaagggctgtatcagcatatcgtgtgtcagagcaatagttcccgaaaagaaaaacgacctgcaaagagataacaaggcgtatgacaacaccagtccgatcagcccacctatgcaggagatcaacaggttctcggtcatcacttgctctaccagcgaaaacgaacgagcaccgaacgctttacgaaccccaatctcactgcgacgtttgcgaaactgtgtcagcgttatacctattatattcaaggcaggcaggagcaaaaggaaaagaaccgtcgcaccggtagttttgaaccattcgcccactgtaccccgatcgaaaccatttgtacccagcacggcctgccactgggtatagggagaatacatatagtcaagttttgtgttggtaagcgaagcattgaaagccgcctgcaacttcagcatctctttgcggatcggttcgaaatcggatgaagaacgtgccaggatgcaggaggtaaactcccccgtagttccttcgcaatagttaacattttcctttaataaggaggagttgaccgtatagggcacccatacatctccataggcgttttcggcagcttgactcacctctttcaccacaccgcatatctgataatcggcataattcatgcgtaaagtctgccctgttgcttcaaccgtaccaaataacttacgtgccagtttatcagaaataaccgcttgccgtatacccgattcccaatcggcatgtgtaaaggggacaccggaaagaaaggtgaaatcgaatactttccagaagccgtcatcggtaaacttaatcgtatatttatcataaaactgctgtccgcgtatattgaccggaagttgtctgtcggtaaaagcagtcactgcctcgggcgtctgcaaaggataaagacattcgcgtactaccttgtgactcatacccccattattgatgggattcccgtcactcccgcatgcttgcagactgttgacaaaaaggatgcggtatcggttagactccggcgcatacgcagagaaatttacttgataaacgaggtaaataagcatcactgctgccaccgacaaagcggtacccgctacagagattccatttacgaaacggttctctttcagcaaattataagattgtttgagataaattgttatcatagtttcacatcttaaaaggcacacaatccaccttttaaaccaaaattccgttggcttaaaaccaacaagcctttggtttaaaccctaaggtgccttgatttaaaaagttttttcggcgtattatttcactttgagtttgttcttatttttgtagttggtcatgtcgctgaccaccaccttgtctcccggattgagtccgctcaccacttctacaaactcaaagttcgaatcgcccagctgaactttccgttttacgatttcatcgtccgaagtcatcacgaacagatcgtattcgccgcggcctacataataagaggcattggctatacgcaacacatcttctttcacggcattcatcacatatacatcggtcttgagtcccgaacgcaaccgcttgttattatcttctttcagttgcacggagaaagagataactccgttctttgaaagcggagtgacactgcttacggtcccctcgagtttctcactgcccactttcacaatagcctttccgcccgctgccacacggtcgccataagtatcggcaatctcgccatccactttgaaatgactcagatccgaaatgatagccacctgccctccctgaggaatctgcgcaccgatctggttgttgatataagtaaggatggctttgcgcggcgaacgtatctgtgcatcgtccaacgtacgcttcatttcggcaagtcccttacggaacatgttgaggtcgagttcaagcactttcaggtcggcggctgctacctgtttctcgttggcatattgttgtttgagttgttccaattcgaggcgggacgtattgtagctcaattcggcctggcgtaccttatcggtcgtaccggctccaagactgtcgaggtattgttcgttgcgaagctccaccttcatccgcgccagtttcatttccgacactttgatctgcatggccatatcgctcaatttggtctggctgttcacctgcgcctgatcgagcttataacgtttcatttgctcttcatccagtagttttttatagtcggtttccgtactttgtaagtcgagtttcaggatgggagtacctacatctacactgtcaccgccctttctatatacttccacgatgcgggtgttgatcggtgaattgatgatctcttcaaaagccggaaccactttgcccgaagcactgacactgacctcgatcgtccccttgtcaacggtagacaacacgagatccttcttctgtactcccgtacgcaacaacgaaattagtaagctaatgcctactatcccgataataccgatagccgaaaaacgaataatctttttattacgctctttattgcgcacctcttttggaatttctctgtccatatatagtcaattatagatttacaaatattctttgtatttctatgatcaaaccttatgccaaaaaaggaaagtactgtgtttcagcaggaagaagagaaacaaggtgtccgataatgaacaccctgtacagtttcgtaacaaaacgtaactgtgttctctgcggtgaaaaacacacgtttgggtgtagccatccggcagaaagggtgtagccctaatagcaaaagggtgtagccatgcataaagtatggctacacccttttgctattaatacatttcttatataccgcagcggcaaagtctacctcagcctcaacctgtctcccacttcgggaacataatccccgtccttacggttcatcttatacaggttcttcaaccggatggcatatttctgagaaatggtatgcatggagtctccgtctttgacgatataaaccgtataaggtttcgacgctctctttttcttctctttcagataaatgatatcaccatccatcaaggtataatcacgttgcaagtcgttatacttcaccaacttcttccaacggatatcgaactctttacccaacgacttaaacgtatctccgtcacgggctacaatataagcgataccgtttgctatgtagacctgatgcggattgagtaccgtcggttcactctttgacgaactccatcctcccttacggtcatatttataaaggtcgtagtcttcaataatcgtaatcagacggttggcatacgaaggatcggtggcatatcccgcctttttcaacccacgggcccagcctttataatccgttatcttcagtttaaacaagaaagcatagcgggcaccgcgtttcagaaatgccgaatggtcctcgtacgaatcacggggattgcgataagcacggaagcattcgttacgggcatcgtcgtcatggcgtacggtacgtccattccagctactaccgcatttgatgccgaagtggttattacttttacgcgccagcgtgctcataccggcaccactttcaagcagcccctgcgccaatgtgatactggcgggtatcttgtgctccttcatttgctctacagccagggcactatacttatttatataatctacgtaacgggaattcctgcgctgcgcctgggcaccgacagaaaaagcaagaactgtaactacggcaatcagcctgagaagtttgctattcatctatataatttgtgtatgttaggttatgcggcacaaaaatcataaaaataattgggattatcaatctcttttctaactttgtaacatgatttgtagaactataaaccacctacccacatgaaagacctgactattacctctgtaattaaagtatatgaatatgaagaactcaatgacgcagaccgtgccttattggatgatgccatcgaggcaacccggcgcagctatgcaccttactcgcacttctcggtaggagcggcagcactgctggccaacggagtgatagtgacaggaaccaatcaggaaaacgcagcctacccgtccggactttgcgccgaacgaactacgttgttctatgccaattcgcagtatccggaccaggcagtgaagactcttgccatcgccgcacgtacagaaaaagactttatcgacactccgattcctccttgcggcgcctgtcgccaggtgattctggaaacggaaaaaagatacaaacaacccatacgtatattgctttacggcaaaaagtgtatttacgaaatacagagtgtgggacatttattacccctgtcatttgacgcatcagccatggaggattgattatgataagaacttaccagacaaaactgaaaggtatgcttgcattgaccacaagctatcataccgaaaagaacttgcagaaagaaaagagtttgtataaattcatatgggtacgccaaggaagcattaccctggagatagaccatcaggaagtgacactggccgaaaacgaggtgatctccctctccaatctccagcatctggagttcctgtccatcgatggagagtatctgacggtgctgttcaacagcaacttctattgtatttacggcaatgaccatgaagtgtcgtgcagtggatttctgttcaacggttcttcgcacgtggtgagatttatgctcaacgaatcggaacggcggtcgatggaagatgtagtgggtttgctggaccgcgaattcaccgtatcggacaatctacaggaagagatgctccgcatcctgcttaaacgtttcatcatccagagtacacgcatcgcccggcaaagactgaatatcacccaggagaaggaatacagcttcgagatcatccgccaatactataatctggtagacgaacacttccggactaaaaagcaagtgcaggattatgccgacatgctgcataaatcacccaaaacactctcgaacatcttttcttcctgtaaactgccttcgcccctgcgcgtcatccatgaacgggtggaagcagaagccaaacgactccttttatacagtaacaaaagttcgaaagagattgctgatattctgggatttgaggaccagtcctctttcagccgtttcttcaaaaacatgaccggagaaagccctgtgcaataccgaaattcggtagaagggaagaattgacaattcatccggcgatattgctatttcccgccgatgggaaaaaccggatctttgcatcagaaagttaaacccataaaaagaaatagcatgaaagagaaatttatcactctgctcacagtagcatccggtctgaaaggtttcggactgaaatttatccgcgtagccatcctcgttgttttcgtttggatcggcggactgaagtattttcattacgaggccgacggcattgtaccatttgtagccaacagtccgtttatgagtttcttctacgccaaagatgcccccgaatataaggaacacaaaaatccggaaggtgcttatgttccggccaaccgcgaatggcacgaagcgaacagaacctacacgttctcttatggattgggagctttgattatgtccatcggtatcctggtattcttaggcatcttcttccccaaagtggcgcttatcggcgacacactggccatcatcatgacactcggtacactctccttcctggtgaccactcccgaagtctgggttccgaacctgggaagcggagaatatggcttcccgctcctatccggtgccggacgtctggtaattaaagatatcgtaattctggcaagtgccgttaccctgctttccgattcatcgcagcgtgtactgaactccctcaaaaaagccgactgggaaaaacggaacaaataaggattacggaatgttataaactgacattaaagatacatccttctaaagtataagaattatgaaacaatatgatgccattattatcggtttcggcaagggcggcaagacgctgaccgccgaattagccaaacgcggctggaaagtcgcactgattgaacgctctgccatgatgtatggaggtacttgccccaatatagcctgtgtgcctaccaaacgccttatccatgaagctgaaaaggtgagttggctctacccaaccagttacgaaaagcaggccgaagcttataaagccgccatcgcacggaaaaacgaaatgacagcagcttcaagggctaatatgttcgacaaactgagcagtctccccaatgtaaccatttacaccggaatggcatcgttcgtttcaaaagatgtggtgaaagtaacccttcccgacgaagtgatcgaacttcagggaaaaaagattttcattaataccggatcaaccagcattataccggcaatagacgggctgaaagacagcaaacgggtatataccagcacatcattgatggaactggatgtattgccccgacatctgattatcgtgggcggaggttatatcggactggagtttgcttccatgtatgcaagcttcggaagcaaagtgaccgtgctcgaaggaggtgacaaatttattgcccgcgaagaccgcgatatagcaaacgctgtaaaagaggcactcgaaaagaaaggaatagaaatccgcctcaacgcccgtgcacaatccatccgcgatacaacggacggtgtaatcctgacttatacggataccgccggcggtacatcttctgacatagaaggtgatgccatcctggtagctacgggacgcaagccaatgattgagggactgaatcttcaggcagccggagtagaagtggatagccacggggctattgttgtaaacggttacctgcataccacctccccaaacatttgggcaatgggtgatgtaaaaggcgggttgcagtttacttatatttcgctggatgattaccggattatccgggacgaccttttcggcaacaaagaacacacggccgacgaccgcaatccggtggcatactcggtatttatagacccgcctctctcacacgtcggactgaccgaggaagaagccatcaaacggggatattccttcaaggtgtcacgccttccggcctctgcactgccgcgtgcacgcacgctgcaacagactgacggcatactgaaagccatcgtcgacagccattcgggacgcatcatgggctgcacgctgttctgtgccgaatcttccgaagtcattaacatagtaaacatggcgatgaagaccggacaacattataccttccttcgcgatttcatctttacacatccaagtatgggcgaaggactgaatgaattgttttcaatagattagtttaacgagaagaggggagaagtttcagatttctcccctctctttttgtaattgccggaatatcttctatctttgcgatctaatttcatacatatggccatgagaatatctaagtaagacaacaccttccggtaaacatcacttttcccaaatgcttcttttcatgtactgttaagcatcacgaatccgtgttgtttaacccctattgtgtttgtctctcccctacctgctatcatcaacagcaaatatttactttcaaaccaatagacaagtatgtgtatccaagtacaacaaatcacctatatccatcccgataaagaagttctttttcaaaatctcagtttctctgtcagcaaaggacagcaattggctctaatcggcaataatggttgtggcaagtcaacattgctacaaatcatatccggacaactgcaaccatgttcgggaaccgtactccgtccatccgccccttattatgtgccccagcacttcggacaatatgataaaatgagcattgccgaagccctcgggatagacggaaaacgaaaagccctccatgccattttggatggagatacttccatcgtcaacttcaatatcctcgatgacgactggaacattgaagaaaaagccacagcagctctcaatggatgggggctcggaaccatgtctcttgaccagcccatgcatacattgagtggcggagaaaagacacgcgtattcctaacaggcatcgaactgcaggaaacttccgtgatattgatggatgaaccgaccaatcacctcgacagccaaggacgcaacaaactgtatgaatgggtgaagaaatgccgttctacgctgattgtagtcagccacgaccgcactctgctcaatctgcttcccgaaacctgcgaactgagccgtagcgcacttgtgttttacggaggaaactatgaattctacaaacagcagaaagagcttctgctaagtgctttgcaacaacaactgaatgaaaaggagaaagaactccggcaagtacggaagcttgcacgtgaggttgccgagcggaaagacaagcagaatgtacggagcgaaaaagcggctcctcaaaaaggcatttcccgtatggccatcaataccctgaaagaccgggcagaaaaaagtaccaccaaactggcggacatccaccgggacaaatcggaaaaacttgtcgccgaacgaagtcagatacgcaacaggttgggcgaagtgtcactgcttaaaaccgatttcaatgcttctgctttacatccgggaaaaatattactgactgcccgtgatataaacttcacttatgaaatttcgtttttatggaaggctcccctaagtttccaactgaaaagcggtgaccggatacgtatcgaaggagacaacgggagtggtaaaactaccttattaaaactggtcaccggagaactattgcctgcttcgggcacactggagcgcaccgcgttcagttacatctatctcaatcaggaatattccatcatctgcaatcagctgacagtgctccagcaagcagagtcattcaacctccggaacctgccggaacacgaaataaagatcatattgaatcgctttctcttcccggtggcaagttgggacaaaccttgcaaacagcttagtggaggtgaaaaaatgcggctcgctttctgttgcctgatgatcagcaataacacccctgacctctttatcctggatgaacccaccaataatctggacatacacagcatcgaaatcatcaccgccaccatccggaattatacgggtagtgtactgctggtatcacatgatgaatattttataaaggagaccggcatgaaagagagtatctttttataattttgcaccggttaaaaaagaattatccaaaatgacacatacaaaaaacaaccggtggttcatcttctaccaagatcagttattagtggaaaagacaaacaacgctttctccatcccttcaggagaaagcgcccccatcgccataccggaaggaacaaccgtacacaccctaactacgcccgatggcatatccggcaaaagtttctacatagattctccgatcacagaaacaccggaatatgtacaaatggggttgcgcgcttcttatgattacctgccgctcgaacactaccaagcagcaggtaaagctcacgaaatcctgtactgggaccgtagcaaccgcttttgccccacatgtggaactccactggtacagaaagagcctattatgaaaaagtgtccggattgcggtaaagaagtctatcccgccatttcaacggcaattctggtattggtacgcaaagaagattctttgttactggtacatgcccgcaactttaaaggtacattcaatagcttggtggccggcttccttgaaaccggagaaaccttggaggaatgtgtggaaagggaagttaaagaagaaaccggactggatgtgaagaacattcagtattttggaaatcagccctggccctatccgagcggactcatggtaggttttattgccgattatgccgggggcagcattcgcttgcaggatgacgaactcagttccgggaatttctatacaaaaaataatctgccggaacttccgcggaagctaagtctggcacgtaagatgattgactggtggatagcacaacagtgaaaaaagacaagctacgaaaggtacacccaccacaaacgaacaaccagaaacggatagaaaagaaatccgttctcagcatcataaacctgtgtacctattcgtagcctgtgttttacagttaaaattctattcaaaaatagtcagctcttccagccctaacttctcttcccagtcactgatggtcatctggcaaagatcagccggtttcatatcggcagggacagcattctgggccaaatagacagcaggagtgcacgacaaagcacaaccaacctgatcgggttctacaaacgtatatttataaccaatataaatacggtcgtaaattacatcctgatcctgtccgcaaagtacaatgctgttggtggctttccggagtatcccttccaaaaaaccaattgcttcgccttccgttgtcgaatcatccccgtaagttccggcgtctttcacaaacaggcaggctcctttactacggtttttcaaaatagccagtccgatcacagaccacacccatgtgggaccgcatgctacaacctttcggcttcctcccggcacataagctccggggagtatgggaaaacgacgctctttggcacggccgaacaaacgttcggttgcctccagcaacggacggatattataaacaggaacgtctaccccttcaggctgtgcctgcatatagataggcatctcctttcttttggcaatgtcatcgtgcattgccaggtcaaatccccagatagctccattttgtccacaaaatgaagaagccttcattagattgacttgtccgagatatgcgtcgtttttctcacagcggtcctttgctacaatcttttcagttattgcatcaaggtctttcacgtcgactgtaccgactgacaatttcattgtcgaaatatatccttcaccacttgcaactccgggattcaaatatcccatgcaaaattctttacttggccctatagcctgactaatcacattagaggcatcataacggatgccggacacaagatctttcatacgtttttaagtttagatgttgcagtaagaacaatatattgccaagaatgattagcctctgctccataaagaaagcaaaagaagacgaagaagacaaaatactaaaaaatgtgaagctatcaatttggtaagttcaaacagatattccatcaatctgcctatcattcaaagagttcgtttcaagcaattatcaagtttaaatcaactgtttatcttatagatagcatactaacagaatgtttgttttaatgatgtgttaaagttaatcatttggaaccaaacaattaattacgtaaaccaatagttaatgattaatcaaaagaaaattaatatcttgggaaaagaaaaactaggaacccggagggtgtatcgaaactcaccacagaggatacagagtaacactgaacaaacaccaagtcactgattatcaacattattattctataataatctgtataatctgtggtgaaaagagttttgacacagctccatcaaaacaaaatgtattatgaaagaacaaaattttatccgatttatggatagcattatcagcgaacaaaaagcaggtaattttctcggaactgcccatatttatcaagccagcctgaatgcattcggagctttcacaggcagcaagaacatcctgtttcgtcagatgacacctgcattactaaaacgatttgaacattatctccgcctgagaggaaatagctggaataccgtctccacctatatgcgagccttacgcgctgtctacaaccgggcagtggaccgccaactggccccctactctccccgcttgttcaaacctgtatatactggaacccaagccgatgtgaaaagatctctcaaagcagaagaaatggggcttttactgcaaatgaaccacactgcacagcatccagaagccatttgccgtgcccacaagatgtttgtacttatgttcttattacgcggacttccctttgtcgacttggcctatctgcaaaagagagacttaaaaggaaatatcctcacttaccaccggcacaaaacaggacgccaacttacagtaaccgttccttccgaagctatggagattattctggaatatatggataccgaccctgactcaccttacttgtttcctattctgagcaaaaagcaaaaaagccatatcaattatcaggaataccaatatgctttacgtgcatttaactatcagttgatacaattggcgcatctattgggaatttcgaaaaacctgagttcatacaccgcacgacacacctgggctaccttagcttaccatcttgaaattcacccgggcatcatcagtgaagccatgggacattcgtcaatcaaagtgacagaaacctacttgaaaccattcaacattaagaaattagatgaaacaaatgctcatattatatcatttgcgaaagaagcatacacaggactaatactttgattatctgagccattactttataggtaactcttctataagtgcgctacaaacataaatcatttttcacaataaaacaaataaaatacgattatttattaaaataagtcattgaatcatcctttataaaagaaaaagacgactatagtctttggtgtacattacattagtatcatgaatgcgcacaattcgctcatcccgtttttaatccccaacgagatgatccatctcctatatgctttatgctacatataaccggaatttaatgttaaaaactcctctcaaagacgcttcttatcgaaaagcggacttcgatcccgttacctataaagtaacggtagatagaggtattacacagatagaggaaaagccgcaataggcaagagaatacattgatttacttacataacatttttattaacgctaaaaaaacagaggtatgagaaaatggacttatctcgtagctgcactcttagtgggaggagcaactacaacgtttaccggatgtatcgataatgatgaaccggcaagcatcacagaacttcgcggagcgaaagcagaattgattaaagcaaaagcagctgtacaaactgctgaagcggcttacaaagaggcacaaattgctatcgtcaatgccaaagccgcttacctggaagaaaaagtagcccaggaaaagcttaaaacagaagttcaagcagccaaaacagaagcgatgaaagcctattggcaacaaaaagccgagaaaagcgcagagttattcaaagctaaaatgcttgagctacaaattcagactgcacaagcacaggccgcttatgaaaaggcaatgatcgatatcgaagtggctttacttggttacaaggataatgcctatgctaccaaattgaacgaactgctatacacgcaaagttttgcatatactcctaaaaagatcacctacaatgaagaatcggggaaaatcagtgtagaagatggagaagagactaccgtaaaaggcctgatcgaactctccggtacattaagcgatgctcaggaagaactggctgacctgatgagacagaaatctttattagaattcagctatgatccggaagcactgattgccggcgttaccaaccagattgccattcagaaaggtgaagtaaaaggtatcgaagaaaacctggcacagctgaaggttgtcgcagaaattccattggatcagtttgaagccaaatacaaagaacttaatgataagaaaacggatcttgacaataaaatcaatgctatcgacttatcaaaagtaagtgacgccgattatcaggcagccgtacaacaggtagctgaagtgcagaaagcaaaagaagcaaaaggtgaattcactttcgatattcctgctgccatccaggatggatttgccagaatgattctggaaaaacaaactttggacaacaatgaccttgccaattcctttaggccagcaataaagatagatcccgcaaccggaaaatactattttcctgatgggttccgcttctctaaaaccatgcaggagaaaagaaacatattagaagctatcactactttattaaccgacaaagtaaagaccagcgaagaacaggcacaggcaaaactggcacaggcacaagctaaagttgactatgatgcgttccaagcagagctgaccaaagtagagggtacatgggcaaaagcatctgaagctttttataaggcagtagatgcaggcaagtatctcagtcaggagggacacgacgcacgcagcttgatcatcgcagattatcagacttaccagaaagattatgaaagtgccgccggagatgcagctaaagaaaaagctgctttagacaaatttattgctcaatacaaaacttatctcaccgccagaaccgctttggacggactaaagctgaaagaagaaacagacattactaaagatgcagccaaactggacgcatggaaggcacttatcattgagaacaacggaacaacaagttatgatgccgtattcggtgtggaggatttgtttaaagctgaaggtggcctcgctgccgatttcgtcaaagcagccaaagccgccggctacagtaacgaacgccaaactacagcagtttacgcagaatggttggcggcttacaataaagcattagccgaacacaccggagaaggagagtttacattcgatcttgacggaatcgccctaacccagaacgggctggcagacaaaacatttggagcaaagaaggagtacgatgctttaacagatgaaatcaacaatgtatctgtatgggccgacctgaactcaaaattaatggctatgggtaccgacaatgataaagcaatcgccgcaacagatacaaaactggcaacagcacaaattaccctgaaccagattacagagaagtacgatgcggagaaagcaagtctggaagtgcagaaagccggtttgaattgcatcttaggtacaatgaaaaaggctttgcctcagactggtgataataatcagccattgtccacttatgaggatgcaattaaatacctgaagaacgaaatagccaaaatcgaaggtgcaccttctgaagttgacgacgaaagtggcaacatcactgtaaagagcggtactctggcaaaggcaaaagctgaactgaatatgtacgatgctttgctgaaagcactacaggacggtagctacgaacaagaacaagcaacagccatcaaacttaaagaagctcaaatcgatgccaaaacttttgaaatcgaagcattgacggtattattcaacaaggcaaaagagatgaaagatcagcttatcaaaacactgaccggagacacttcagccgaataaataaaaactaaaggaaaaaagtatgattaaaaaactatgcataatccttctgactgcatgtactgttgcgccacttatggcgcaacaacgcagcagcagtgacgatgcgtcgtttgccccggaaaaaggtaactggcagatatccgtcgcattaggcaattcacagcaattcgccgatggtatggaatacttgttaccgaaatactggaacggaaccggaaacgcgccgggcattggcttgggcgatgatacaggcaacaagtctgaagatccgggcatgtatctgaatctgggaagttggaataataatagcttggtcaacatcatcggtttgcagggaaaatatttcctgaccaatcgttgggacgttaatctgatgttcagcatgaacattggagtcaccccgaaaaaggatttcattgaaggcgacaatagtgtgtccgatatgcaaatccccgcttccaaatatgtagaaggacgggtgaaaaacaactggatggtaaacattggttcaaactattatttcaatacgaaaaacgaacgtatcaatctttatgtgggtggccttataggctggcaaatgggacgaatcgaaacgatgtctcccaacacgggtgaaactgtaagcgacggtgatgcaataactgacgatgacgatttgaatgacgcagaaacactgcctttacaagtatatatcccttcgaccaaaaccggacaaatattcggattacgtgcggcagcggtagccggcatcgaatacagcctgggtaaaggactggttttcggatttgaactgcaaccggtagcctatcgctacgacatgattcagatttgtccgaaaggggtagccacttacaaagtgggacatcataacataaacttgtttgcacaacccaatttgaaattaggatttagattttaaataagtccagatattacgaaaaaatcaccccgtcctaccttcgggtatgtatggggtgattttttacttaacgaacatcacaaccaagatgaaaagaataacagcaggaggaatcatactgggaaccatctttctggcagcatgcaaccatgcccgacagaacggtagctattatgtcagcggcatagtaaccaaccctcaaatggaaggcagaacaatctatttgcaggatgctatccacagcacaacccgatatgacagtacacaagtgattgactgtcggtttgcatttgagggaaaaatcaattctcccccaagtcagggaactatttattcaggaaaatgacagtgaccgctttcctgttactctccctatcgttgtcgaagcgggaaaaatcagcacgcaaataggagacgtagtccaagtggaagggaccgcactcaacacagagatgatgcaatttcttcttgccatcgatcagttcagggaacacgacttctccggaaaaagtgtccatgaaataaaagaaagctttaccgggctattgatggaacagattataaaacatgccagcagtcccatcggaaagtatatctatgcggcatacggaaacaagttaagcacagggcaaagagctatcgcaaaaaaaaatctgggcattaactaaaaaccatacatccgggaaatacagacgtgagtttcacctagttctccgtctgcccggatcttttagtgttgtgagggtgtgtcgaaactcaccacagaggacacagagtaacatagagcaatttttaagttattgattatcaacattcttattctgtgataatctgtgtaatctgtggtaaaaagagttttgacacagcccctttaaaagaataatcccaaaagaaatgccccatccaattcaggacagggcatttcgataatactataatactatggacacatttatattacccaaagtatctgttaaaagagtgcttaaagaagttccttaaatacccaacgatttcttcacagcttccactttttcagtagcttctgcatcggcagtggcaaagcagttgcggcatcccatctggcctttcacttcgatgtagaatttgatcttcggttccgttcctgacggacgaacagacactttaccaccatctgcggtgaaatattgcagcacattcgatggttccggcatatcgatgtcacttacatgaccttctgcatctgtctgcttcagagttttatagtcttttgacagaatcactttcgagccacccaactctttcggaggattagcacggaagttttccatcatggctttaatctcttcggcaccgctcttacccggtttcactacgtttacagtaaattctttagagaatccatattcaacgtaaatgtccatcagcaactgatacagagtctttccattgtctttagcccaagcagccacttcggcaatcaggcagcaagcagaaacagcatctttgtcacgaacaaagtcttcggccagaaaaccgtagctctcttcaccaccaccgatgtatttcttcttaccctcacgtaaacgaatttcacgggcgatccatttaaagccggtataacagtcgagcatctcaatttgatttttgtcggcaatcttcttgatcagttcggtagtaacaatggtcttcacacagaattcattaccggtcatcttacccagtttattgtattgagtgatgatataatacagatacatcaggcaagtctggttaccgttgatcaatacccattcacccttatcgtccttgcaagcgatacctacacggtcggcatccggatcggaagccattacaaggtcggcatcgatttctttagccagattgagagccattgtcagggcttccgcattctccggattgggagaaacaaccgtcggaaagttaccatccttaatcatctgctcgggaacagtgtatacattttcaaatccccacatcttcagtgcacggggaatcagcatcatacccgtaccatgaatcggagtgtagacaatcttcatatctttatgacgagcaatagcttcaggatcgatagaaacggttttcaccatatccagatatattttatcgacatcttccccgataatctgaatcagctccggattaccctggaacttaatgtcggcagcagaagcaatcttgttcacttcgtcgataatacctttatcgtgcggagccagtacctgtgcaccatcatcccagtaagctttataaccgttatattctttcgggttgtgtgaagcagtcagaatgataccgctctggcaaccaaggtgacggatggcaaaagacatctccggagtaggacgcatctcctcgaacagatatactttaatgccattggcagagaaaatatccgcagaaatcttagcgaacagagaactattgttacggcaatcgtatcctaccacaacagaaatctgtttcagattcttaaagtttgcgttcagatagttagaaagtccctgagttgcggctccaacagtataaatattcatacggttggtacctactcccatgataccacggagtccgcccgtaccaaattcaaggtctttgtaaaaggcttcaatcaattctgtcttatcttcgttctccagcatgcgtttcacttcagcctgagtttcggcatcatacgccggggtcagccacttctcggctttctcagtcacctgtttgattagttcttcattccccatggttatatctatttttagagattaataattattctattcaaaatacaaatgtaaaagaataagtttgaaattcctatcttttagcgagaaaactctccggaagcgtttattcagtcactttataacgttcgccggtttgcttcacatattcctcaaggaattcttttgaatagcccggacgtaccacaccggcgggttggccgatagcgttgcgctcgaacttaccgtccttcatcttgcggatgacaccgtcattatacttcacaatgataaattctcccagacgtttccaggtgtcgaaagtgctttgcgccgtcatgttggtataattggtcagaagcgccacagctgcttccggatttttctcgtacagtttaacggcagcagactcaatcccctcctgcgcctcgttgaaggtggtttcaagttcattctgtgtggaacgtacatcaccgatcatcaaatcgtaacggggatataccatattagccacccagttgaaaatccagaaagcagaattccatgagaaagtgatgtaatcggcaccatccacacgggtatagcataccggaactttggtagtacagcaatatacgggagtgaaaacggtcatgttggcatcatccgtaccgaaccagagtacaccgcctactgcatcaggcagattggcacgcatctgggccacaaaaacgaacccactctgctgtgtagaaataggacgttcgttgaagtattcctgatcgcccactttaaaagtcagcggagagaggcgataaggtgttttataaggtccggcaccaaagtcattgctgatatcaagagcagttccttcataatggtcacgcatggcattctttacgtcctgaactgaaagtttgcgtttcggtttcacgaacaaaggcatcggttcgttggtctttccctggatataaggcagataagcctcaccctgatcggtaaacatattgaaatagctccatacacgggcctcgcaaaaacggcgggcaccgaaatcaagcggcgcataagcatcggcaaaactgaaatctttattcactccgttgaaatatcctttttcacgggcaaaggaaatgacatcgttggagtacatacagtttgccttgtcattcatatcaaactgatggatacgagactggttggcatgtgccgagatgcagtcatcgggcacacgaacagctacccagacggctccccgtatgccgggccctttccctatcatttccataatccatatttcattaggatcggcaatggtaaatgactcaccactgctataatatccatattcctgaaccagctcagtcatcaccttaatggcttcacgggcagtgcgcgaacgttgcagtcctacgtaaatcaaacttccgtaatcgataatgcccagtgtatctaccaattcaggacggccgccaaaggtagtttcaccaatggttacctgaaactcgttcatattgccgatcacattataagtctgacgcgcctgctcaatctgtcccagatattttccggtatcccattcatggatatccatcatcgtacccttgggataggtagctgggggataatgatataactcgccaaagagtccgtacgagtcagccgaataggaaacaatggtcgaaccgtcggtagaagcattcttaccgacaattaagttagtacaggcgaaggtttccgccactgccgcagtcaagagagcggcaaagagaaagattcttttcatataataaattattaatataatatcttattctgttttacccggataatctccggttatttggttttgaaagctaccagacgaaggtttcacgaaccgttgtctcgttcccgcaatcgtctgtagcggtcatctctaccgtatggcgtccacctttctttacatattcaggatcgagtttacactcccaatacgattttgtcaggttaggacgtccgaacagagcgaattttccatcaatcgtgccacgataagaccggatgccggtttctttgtccttcagccgataaacaattttcccattacgtccccagacattcttgcccaccggaataatttcgggaggcactgtatctactcctaccgtataagtgcccaattcacggatacgggttttcataaatccaccctcgtaagttcctccggcactatacataccacctttgggagtaacacgagccacgtaatatttcgttgtatcggcaaccggctgatgacgaagcccgatacgcaactcacagccaccgtgcaacggcactttctcatcattgagctgataggtgtaagcaattgccccgctgtcggaacgtacttcataattgagagccacattgtcgtataacatcccccgagggacggtaagggtcaaaccgggttcttgcaaaaagttcgttttgtcccaagcaaagaagtacttctcccgatgttcagacagctttatcggctgtttttttccacgcaccgtaaagtgatagcgggaagtgttgccaaaagcgtctttcaattcatattcgaacttgtaatcccgttcttcattgatggtcaccaatccacggttatcattcgaagcccggagcatacgcagcgtattgcccggatcaataaatgatttcatatattgcccgtaggtccaggagtttatcatccggttctcatccggagcaaagcgatcgaccacactacgaaacacttccgttccatctaccttgagcacaacagtatgcacaccgtaacggttgtgaacaccgtccatgtaatcataagccttgatacccgatccgatcactccccatgcctcgatgggacgcgtcccattgggttggaaggtttgccgctccgaactgccttgcacgattccggttcccggctgtggaaacaacataacgccctcagcccggggagcagtggtatcttttatttttgatttgaaaaaaggcatcggatcgacagattcaccggtagcggtttccagcaagtccagatgcaggtgcggtccgaatgaataacccgtattaccgctccaggctatctgttgtcccgcctttaccggatattcccccagttcgggaacaatctctacttcccaatcttctttttcgtattgaagcttcttcactcttcgggcaatgtccggcataaatccgctcaagtgccggttaatagttgtataaccgttattatataccacatcgagtacatgtcccgaaccattggtgacacgaatacgtgagatgtatccgtcggccagcgcgcgcaccggtttaccgacaactccctgagtcttaaagtcaagaccgccatgaaaatgattggcacgaatttctccgaaattaccgctcagagtcagtgtaaagtcaaatggaggaacaaaagcagcctgcttcacatcttgtgaatgtccctgaatgctgcaggcaagcatcagagcaactatatactgtttcatgtagtttgcttaaaaatggaatctttgcaaaaatacattattcctgccatatcagaaaacagaaagatggattttattcctgcctgccacggctctttcaccacgccttcctctcatacaaaaaatacgtttcgatcttccatcttccaccttttagaatgcatatcgttgattgtaagatgtatagattggtggaagatgcggtttttatgccatttatcttccacccccatcttccatcttccacccgctgttttaggggatattatagaaaaaagtattttgtttataacagagaataatccgataatagtagaaaaaaaatataatgagcgtttagagtattttaaaaagagaagaaatctagttaagatacaaaactatagaaatacattttatgatattgaacaatataaaattgctaattgggctatttgtatgaattcaacttataatagcaaaagtatggtttcttattttaagaagttatatcatataaatgttaatggtttttttaatgaacattttattttaaaagaaaatactgatacagaaagatgtaatagttttgtatggtttggctcaacaggagttatacataaaggattagatatattagtagaagcttttgctaaacttccttcaaaacgattgaatatttatggaatttcaaaacaagagatagcaatgattaaaccttatataggacgaaatacatttctacatgaaaaaataaatgttatggataatacatttatctctgaagttgttgaaaaaaatgcttttattgtttcattgtcttgttctgaaggaatgcaatcaggtgtggctacatgtatgctccatggtttaatacctattgttacgaaagaaacaggctatgaatcccagaattttatttttgaatttagtgattatcatttggatagtgtggtgaatactatattacatacaagttctttatctattgctgagattaatagattgagtcgcttggtttacgattatgcacataaaaactttagtttaatttctttttctaatcgatttgaatgtattataaaagatttgatgaaaaataataatgaatgaatttaatattttgtttttaggttgcttttatccacattattgtttggaggatattttaacaaacaccaaaggtaagtgtcaattcgctgctgataagcttcaatgggctttgattgatgggtttatacaaaatgaggttaatctagagttgttgtcatttcctgttataagtacttatcctgtaggttataaaaaaatatattttagaggaggaaattttgtctataaagatattaagggctattgtgctagttttttgaatttaccatttataaaatttttttgtgatgatttatcagcaaaaataaagaaatggtatttttcaacttctggaaaaaaatgcttgtttgtttattctttacaggtcaatttaatgagagtagctttgaagatgaaaaagaaattcccggatttacatttgtgtataattattcctgatttgccagaatatatgggatgtagtaaattttataaattcattggggctaggaaagtagagattgattttatttacaataatataaataaatttgattcatttgtgttattaagtaaacatatggtagataaactaaatattcaacattcaagatatacggtagtagagggaattttctctggagaaataaaattgccaattaataaattggagcagaaagaaaaagtgattctttatacagggaatattaatcgaaaatatggaattaaagaactagttgatgcttttatgcaaattcccggtctagaatatcgtttatggattcgtggtgatggagaactaatgaagtatgtcatagaaaaatcgagagttgatatgcgtattaaatatcttgctaaagtgactcaagacgaactggttttgttacagcaaaaagcaactttacttattaaccctatatcaaataaggaggaaattacgaagtatttttttccttctaaaacaatggactatttagcatctggaactcctaccttaatgtatagattagaatgcttaccgcaagaatatgctgattatttatattttatacctaatggtggtattgatgctataaaagaagcgataataaaagtttgtgagaagtccccaatagaattagagatattggcaaaaagtgccgctgattttattataaaatataagaatccccgtttacaagtcttaaaaattttaaatgttattaattcgaattgattatatattacattattatataaacattagttatagttaaaacattgagtgttatgtcattatttagaggtaaaatattattaataactggtggtacaggttcttttggaaatgctgttttacgtcgtttcttagattctgatatcaatgaaattcgtatattttctcgtgatgaaaaaaagcaagatgatatgcgtcatcatcttaaaaattctaaggtgaaattttatattggcgatgttcgtgataggcattccgtggatggagtaatgagtggtgtggattatatttttcatgctgctgcattaaagcaagtcccctcttgtgagttttttccaacacaagcagttcggacaaatgttcttggtacagagaatgtattagagtctgctgttgctcacggtgttaaaaatgtagtggtactttctactgataaagcagcctatcctattaatgcgatggggattagtaaagccatgatggaaaaagtagctattgctaaaggccgtcaattaggtgctgagggaaagacaacaatttgctgtactcgatacggcaacgttatgggtagtcgtggctctgtaatacctttgtgggtagaacaaataaaagaaggtaatgctataactatcacagatccaaatatgacccgttttatgatgactttggatgatgctgttgacttagtaatttatgctttccagcatggaaaaaatggtgatttgtttgttcagaaagctccggctgcaacattagatgtattagctgatgccttgaaagagctttatcatagttcggctaaagtgaaggtaattggtacacgacatggtgaaaaactttatgaaacacttgttacacgtgaagaaatgtctaaatccgaagatatgggagattattaccgtattccctgtgatacgcgtgatttgaattatgacaagttttttgttgaaggaaatgaagaagtctccttaatagaagattatcattcgcataatacccatcagttagatgtagagggtatgaaacaactactccttaaacttactttcattcgtaaagacttaaacctttaattcctaattttttatgataaaagttggcattactggccaatcaggttttgttgggaggcatctctacaacgaatttggtttgttgcctaaccagattatgcgcattccttttgaagattcattctttgagagcgatatgaagttgcgtttgtttgtgaaacaatgcgatgtcatagttcatcttgctgctgtaaatcgtcacttagatccttctgtaatttatgatacgaatattaggttggtaaaacagctcattgcagcaatggagatagagcaggtaaaaccatatctgttgttctcttcgtcaactcaagaaaagtgtgataatgaatatggaaaatctaagcgtgacggacgtgaattattaaaggattgggctatacgtaatgatgcttcttttacggggttggtcgttcctaatgtatatggtccttttggccaacctaattataattcttttattgcgacattttgttataaattgactcatggagagcaccctgagatattacaagatagtgatgttaggctgatttatattggaaatctctgtaaatatattgtgaataaaatacatttagtttatcactcatccgtctctatagttgaaagaactgaaatcccctttgatttttcaaagaaagtgacagatgttttgagtttactgaatagttataaaaaactctattttgatcatggtattatcccaacattaaaagatcaaaatgaagtaaatctatttaatacatttcgtagctacattgattataaaaatcattttcctgttaaactgacttctcatactgatcctcgtggaatttttgttgaaacaataaagttaggagtgggggggcaagtctctttctctacaactgttcctggtattacccgtggaaaccattatcatagccgcaaaatagaacgtttcacggttattaaaggtaaagctcttatacagcttcgttgtattggaacagaagaagttttggaatattatctagatggaaatgaaccttcttatgtggatatgcctgtctggtatactcatagtatcacaaatgtaggtggtggagaactctatactcagttttggataaatgaatggtatgatccagaagatggagatacttattatgagaaaatataaaattaaaatatgaagaaattgaaagtattaactgttgtcggcactcgtccggaaataatccgtttatcatgtgtgctacagaaacttgatgcaagtcctgctatagaacatgttttggttcatactggtcagaattatgattatgaattaaatgaagtcttttttgaggatcttagacttagaaaaccagattactttttgaatgcagcaggaaagaatgcaacagccacggccggacaaatattaatttgtattgatcctgtattggaggaagtgcaacctgacgcctttttggtattgggtgatacaaactcttgcctttgtgcaatagcagcaaagaaacgtcatattccaattttccatatggaggctggtaatcgttgttttgatcagcgtgtaccagaagagagtaatcgtaaaattgtggatcatatcagtgatattaatctgacttatagttctattgccagggaatatcttttgagagaaggacttcctgctgatcgtattattaagacggggagtccaatgttcgaggttttaaatcaatatctcccccaaattcaatcttctcatattcttgagatccttaatttagaaaaaggaaaatattttgttgtatctgcccatcgtgaagaaaatatttccagcgaacagaattttatgaatttagcagtggtgttaaatatgatagcggaaacttatggttatccggttattgtatcctgtcatcctcgtactcgtaagatgattgaagaaaaagaggttacttttcatgaattaattcggttgatgaaaccgatgtcattgagtgattataatcaacttcaattgaatgcaaatgcggttctttctgattcgggaactattagtgaagagtccagtatcttaaactttcatgctttgaatattcgtgaagcgcatgaacgtccagaagctatggaggagactagtgtgatgatggttggtttgaatccagagcgtgtaatgcaggctctggccgaacttcagaagcagaacttagaaaatcgtaattttcgccttgtatctgattattctatgcctaatgtaagcgacaaggtagtgcgaattatactctcatatacagattatgtgaaaagagtggtatggaataaggtataagagatgaataaaacgattgtatacattggaggtttcgaactaccggataaaaatgctgctgcacagcgtgtggtatctaatgcaaaaatatttaggaaactgggatatcatgttatttttgtaggtattgataaatacatggcagacgatgtcgaatttgaggatacaaaattggaatttgaaggatttatatattacagggtaaaatatccgtgttcaatatttcaatgggtaaaatatctgtcggatgtttctttcttatatagtttgaaacaattttcacccctcttcattattgcatataattatccggcattagctttgaataaattgcgtaaatgggggctgtgcaatggtatttatattttgtctgattgtactgaatggtattctcctcaaggtagtttattatttaaattcataaaaggtgcagatacttggctccgaatgaaaataattcatcctaaactagatggtttaattgtaataagtagatatctctataattactataaggataaaaatactaatattatagaattaccacctctagttgacttaaagcagggtaaatggaagatatctcagaaatacatgaataatgaacgcgtctctttgatatatgctggttcaccgggaagtggtaataaggatagacttgatttgattgttgctgcactatatgatattcagaaagaatataaaattgattttaaattcttgattattggattgacgtcggaagaatattcacaactatacaaggtagatttacctaaagatattctttcttatatagagtttaaaggtaaaatatcacacttagaagttcttgaatatatatgtaaatccgattttcagatatttataagagataacaatagacctaatatggctggatttcctacaaaatttgttgaggctatttcatgtggaactccagtattgactaatccttatagtaatttgtattcataccttgatcaagggaagaatggttttatcttaaatattgtcactaaggaagcgttgatagactctttattaattccactgaggttgactagagaacaaagaaataatttaaaaaaggaatgtcgacaatatacaaattttgattttagaaactatttaactttagtagattcttttttactcaatatcgtaaaatgattaatttgttcatcgtagttaacgttgattggttttttctttctcatcgcaaagacattgcattaactgctcaaacatctggttacaatgtcactatcgtaaccaaggataccggaaaaaagaaggatattgaggcgcttggtttgaaggtgatcgatttgcctatgaaccgatctggacaaaacttattagaggaattatatacttgttggtttctttataatttatatcgtcgtaaaaatccggatattgtgcatcatgtcggtttgaaaacgattctttggggtacgttagcagcgaaattagctaatgttcacgggatcgttaatgctgttagcgggctaggtgtatttttttcagaggaaaaccgatctattatttcaaaagtgcttcctaaagtacttcgcttttctcatcatcataataatcttgctgttatttttcagaatgatgaagacaagtcattatttttaaaacatcagatcataaaggaattccaagcttataaaattaaagggtctggtgttaatttgaaacagtataattatactcctgaaccggaggaaggaagaataaaagttctattagcagctcgaatgattgtagagaaaggaattttcattttgacagatgctgcaatgaaacttaagggacaatatcagaataaagttcagtttttattgtgtggtggacttgatgataaccctatggctatcaaagaaagtgaattaaaggcagtatgtgatgggaattatatcaagtggctaggttatcgttcagatgttctggatttgttaaaaaaatgtcatattgtcgctttcccttcttactataaagagggattaccaagggctttaatagaagcaacagctataggtcgtcctattataacgactaattcaataggatgtaaagaaacagtaatagatggctacaatggatacctaattccgattaaggatagtgatgcgttgagctatcgattagatattctctttaggaataaaaatcttaggctaaaaatgggattaaactctcgaacattagctgagcaatatttctctatagacaatgtgatctatacacatttacacatttatgaaacattgttagagaaataatatgggtagaatttatttcgaagatgtaaatatagctaaaggaattgcgatgctgcttgtcatattaggacatagtcctattgtatatcctattgatttgcaacagattttttggtgccgatggctcgtggatgtaatttatagttttcatatgccttgtttctttctattattaggctttttatttgctaatactacggcacaagggcacaaaaatattattagtaaggtacgtagaattcttgttccatatttctgtttttcaatattaatattggggataaaatacatcatcccttctttggtaaataggaaggttgactctattggaacatacattgataagattcttttttatggaggagaatattggtttgtttatgtattattttttatatttttcatatttgaacatttacgttattttttgaataaaaagatattggcttattggttgttgttattattgattattgtttatgtgtctggtattgttccttttgcttcaaatttgtttttgaatgatattattgtttattattctttcttttttgtttttgggtatgttttttattcacaatatcaatggtttaaaaaatggatttctaaagattgtatatattactctttgtgtttcttatttggagttactaatattcttttgatacatgatttagagaaaattttattattaaaaaaatatgtcttgccaattattggtgcatttttctgttggagcttatcaatgagagtgttaggttttgttcaattgaggaaaatatttggttatttgggcaaatattcattgcagttttatttgtttaatggttttgcactaacttttgtaagatcattattagtttcttacttgaatatttcaaattcagttatattagtcatacttatttttagtttatgtgtggtattagaatttgtaatgattgaaattactcgcaagattagtcaattatcgttcttttttggatattaaatgaaattattggtaaccggtgctgccggatttataggttcgcatgtttgtaagcgtcttttgcaacgtggggatgaagttgtgggtttggataatatcaattcgtattatgatattaatttaaagtatggacgcctttcgagcttaggtgtttctcaatctgaactgtcatggtataagttcacacggagtaatgtttatcctcgatttagttttgtgcggatgaacctcgaggataggcaggctatgcaaatgctgtttgctaatggaaattttgatgtagtaatcaatttggccgcacaagcgggagtgcgctactccattgagaatccatatgcttatgttgaaagtaatatagacggttttctgaatgttctcgagggttgtcgtcacagtcaggtgaaacatttggtttatgccagttccagtagtgtatatggtttgaatggacaggttcctttttcagagaaagatggcatcgcccatccggtgagtctgtatgccgcaaccaagaagtccaatgaacttatggcacatacttatagccatttatataatataccttctacgggtcttcgtttcttcacggtatatggtccctggggtagaccggatatgtctccttttctatttgcggatgctatcttgcatggtcgccccatcaaggtctttaacaatggcaacatgcttcgtgattttacatatatagatgacattgtggaaggtgtcttgagagtggctgattctattccggaagggaatcagtgctgggatgctgaggttgcggatccaagcatgtcctgtgctccctataagatttataatattggtaattcccatcctgtaaaattgatggattttatacgtgctatagaaatgtcaatcgggagggaagctgacaagatctatcttccgatgcagcccggggatgtgtatcagacctatgcggatacttcttctctttcgcgggaaattggttttcaacccaatacgtccttagagacgggcgttaaggaaacaataagttggtataaagaattttataatctataattatgaagattgctatagttggtacaggttacgtcggtttggttacaggtacctgtttctctgagatgggagtagacgtcacatgcgttgatgtgatggaatctaaaattgataatcttaaaaaaggcataattccgatctatgagccgggacttgaagacatggtgcaccgtaattacaatgcggggcgtttgaagttcactacttccttagcttcatgtttggatgatgttgaggttgtgtttagtgcagttggtactcctcctgatgaagatggcagtgcggatttaaagtatgtgcttgaagttgcccgtacgattggtaaaacgatgaaccattatgtactggtggtaacgaagagcacagttcctgtcggcacagcgcaacaggtgaaagctacgatccggggtgaattggataaacgcggtttgaatcttgaatttgatgtggcctccaatcctgaatttctgaaagagggagatgccgttgatgacttcatgaagccggatcgcgtagttgtgggagtcgagtctgagagagccaaatctatcatggagcgtttgtataaaccgttcatgatgaataattatcgtttgctctttactgatatcccctctgccgagatgataaaatatgcggcaaactctatgttggccactcgtattagttttatgaacgatattgcgaatctttgtgagctggttggtgcaaatgtaaatatggtccgtaaggggatcggtgctgattctcgaataggtagtaaatttctatatccgggttgtggatatggtggttcttgttttcctaaggatgtaaaagccctgataaaaacggccgataagaatgggtattccatgcgtgtgcttaaggctgttgaagaagtgaatgattctcagaaaagtattctttttaataagttgatcagatattttgatggaaatctttcgggaaagcgtattgcgttgtggggactgtcttttaaaccggaaacggatgacatgcgcgaggctcctgctctggttctaataaataagatattgtcttgtggcggtcttgttaaagcttatgatcctattgctgttgaagaatgtaaacggcggataggggacagcatagagtatgccagtgatatgtatgatgcggttcttgatgcggatgccttattactggttacagagtggaaagagtttcgtatgcctagctggggtgtattgaaaaagacgatgaatcgtgctttgattatcgatggcaggaatatttatgataagaaagaactgcatgatatgggtttcgaatatacgtgtattggacagtaatgatgaatatattagtaacagggattcatggctttgtgggttctaacttggttgaagctttaaaagagaattgtatcttttatggtttggatattgtggctcctgttaaagatggggtattgaaaactttttcttggcaagatattaaatctacttctttttcttcccaaactcttcctaagtttgatgtcattattcatcttgccggaaaggcccatgatacgaagaatcaatcggccgctcagtcctattttgatatcaataccggttttacccaaaagatctttgatttctttctggaatcatctgccaagaaattcattttctttagttcggtgaaagctgctgccgatagtgtagtaggagacgtgcttactgaagacgtgattccgactccggttggtccttatggggagagtaagattaaggcggaagaatatataaaaaatcattttatgtttccaacttcttctattagtgaggatcggtctttgcggttagagaaagataaggggaggatacccaagaataaacaggtgtatattcttcgcccctgcatgattcacggaccgggaaataaagggaatctgaatttattatataatgtagtgaaaaaaggaatcccttggcctcttggcgattttgataatcgccgttcgtttacttcaattgataacctttgttatgtgattgagggacttttgaatcaggatgtacctacgggcatctaccatatgggagatgatgaagctctgtcaacaaatgaactgattggcatcatgtgtgaagcaatgggaaaaaagccgcatatctggaagatgaacaaagggcttatggaaggatgtgccggcttgggtactctgctgcatttacctttgaatacggaaagacttcgtaaattgacggaaaattatgtggtaagcaacgctaagatcaaagccgctctcgggattgataaattacctgtaacggctaaagaaggattgatgaagaccattcgttcatttgaagaaactaaataacttatgtactatctaatcatcttagttctgctattcctggcagaacttttttatttccgtattgcggataagtgtaacattatcgataagcctaacgaacgtagttcacatacccggattacactgcgtgggggagggatcatcttttattttggggtgttggcctattttctcacaaaccactttgaatatccatggtttatgctggctttgagtctgataacttttatcagttttatagatgacattcgttctacttcgcaaggattgcgtttagtctttcattttacggcaatggctttgatgttttatcaatggggattgtttagcttgccttggtggacaatccttgttgccctgatcatttgtactgggattattaatgcttacaactttatggatggtattaatggcataacaggcggatactcattgatcattctgatagcattggcctatataaatagggtatatgttccatttgttgaaacggactttatttatactatgctttgcgcagtattggtctttaatttttttaattttcgcaagaaagcgagatgcttcgccggtgatgttgggtcggtcagtatagcttttgtgatcctttttctgatcggaagtttaattatcaaaacagagagttttagttggctcgtattacttgctgtatatggagtagatagtgtgttgactatcattcatcgattgatgcttcacgaaaatattggtctgccgcaccggaaacacttatatcagattatggctaatgaattgagaataccgcacgtagtagtatcgttggtgtatatgattgcgcaaattataattatcatcggatatttatattgccaaaattatggttattggtatttattgggttgtatcatcttgctgagtggaatatatattgtttttatgagcaaatattttcacttgcatcttttacctaaaagataattattatatttatgataatcttggttatggtcgttattaatccttttatagttggaggatacgtctgataatcccttctataacttacttttccggtttctataaactgttttaataaggatgcaattaatgcatccttatttttttgcttcgtttatggtgtcttttatacacgatatatcccgaaacgaggatcaacgttagcagaagtccggagataaaaacgaatagatccgagaaaacacctaagaaaggtgaatagcagcgaccgacatggagttctaagcagaaattccataatgacatgggttgctgttgcataaaaacaggcattgccggcaatgctaaattattctctttattgcgtgctccgttgtcgtattcgaagattacctcccgtgtgattaaatcgtcggtgaatccgttaacgagactgccgccgagcggtctcccgtaagttgctgccgggggttgccctgtataataatcgagaacacttcctgtagatggattccagataaacagtccgctaaaagagccgattaaccattcgtccgggtttttcggataaaacacattaactcccataggacttaccggtggggttcgttttaatttaaccggtggcagtgtaaagtcttttataagatagaaaccggttgacgaagacaataaccagacattttttgatgcgtcccatcggatactgcggagtttgtcatgccacggattgtctgaatcaagagttgttccggggatggggttcgtgttcaccagaacaaaaggtatcattaagggcggtcggagacacatacccgtaacagataacaatatggtcagtacgatcagccatgtacccaatttattgtgccagttcagtgaagttttcaaggcctttgcctgtgttttgacagggagcctttttctgtgtcttcggcgaatgaatgagggaagaaaagtatatatgattcccgttatactgagaatgattaatactactcccagaaaatcaactaccagtttgccgggtgtaccgaacaactctccgctatggaggagccagatggtacggaataaggaggttttcggtgaataattttcgggggcttttaattctatttttttgaattgatggtaaggagatacactggtatacagattagaacgtgtgagcacgaccagagtatctccgcgttgggttatatcagagattcgttcttcatttccggatatcggatactcctgccatttgtttttgtccaggagatagacagagtataatccggcacaccaaatatcgttattggcaaggcggatgatattacttattttgcgattgtcgattccccgaaccagaccttggttgaaatcggtaaaggtgatgaaacaggagtctgtttgccagactcctgcattaccatatgccagaattttcccatcaggaaggcgtaatgttccttttataattccattattccagtttctgtagtgatagctttccggcatccagtttctgttgacttcaacttttgaaaaaagtgtacggtgattgagtacaatgcctgagaaacagaacatcaggataaagaagctaaagaacaaacctacccatttatggtatttcttccagaaatttttcattagagattgttacttagtttaaattggtactgccattcggctgaatggcgtattcaaaggaataaatgccactattgccttcgtcatcataaaaacttttggcttttagttttgcatatttcccactggctgtgcggacgataaatacataatcacttggcgtgtaagtgggaggggggccggcaaaagtgattgctttacaaagtacttcgttggcagtagactccatggtaggaggaggaaatccggtgccgggagcggtaatggtataggctgcatcgacagtgaatgttccttgaggaactgtcgtacaggctgccatatctttgatattcgtgagtaaagcaccgccttttcccttaccggacgcgccgctgttggtacgcacattgtaacggttgaatgcgatatcccaatctgtgttttcggcatgggcttcttcactgacgtttacttcttttcctttttcaagtgaataataaatccagtcgttcccatatgctgttttccggctcaggcttacctgttttaccggtaaagcacctcccccctgtgagggatcgtcgggcagagaaccgttattgtcacctgagcaggaggtgctgataaatgctgatagtacgccaaagaatagaatggcgaatctgaatttgcttttgttgttcatacttgttttagtttaatttatttatagtgtataattacatgcgataaaataatttcttcccggtgaggtagaggtattgaaggttacccggtctgaggtataatcgaacaggttggttattcctgccgtgattctcaggttctgcatgatgtattgtgacaccgtcagatcccaaagacaataggggttcaccttagcctgatagtaggcttctactttctttccctctatttcgagttcgtccaatacgtcgaatctcttttttcccatgatattgccggacagattgacaactgtggcataacgggggatacgtgtattgtattcggcacggatgttgccggaatgtggactggaagaacttaaccggactccgtcagcgtctttgcttgtgtagaggtaattgtaagctccgtgtacattgatgtgtctgtttatctgtaccttgcacatggtttcaactcctgccagatgacttttccccacattggtataatggagttcggtttggtcattactccacattccttctattttgtttcggaaccagttactgtagatgttggtattgatattgatccaactattcacgtactctcctgaaagtgatatataattgttggtttcaggtttcagtttactgttgccatatatccagaacatccccaggtgatcccaattcatatagagttctttaatgctgggcgaacggtatccgcgtgcataattgaagcggactgtgaatgggaatactttatacatgacagaagctttgggagtgatgttggcaccatatttttcatgatagtcacatcgcagtcccgccacaacggagaattgcttgttgatactccaatcgtcctggaggaaagcggtagcataccattggcttttgttctcttttacaccggtttcgaatttatcactgaacaatgactctctgtaaaattccaaaccgcccgtgatggtctgtttgtccaatgcagtggtagtgtaaacgacgcgtggctgaataatattgtttttatattcaaggcggcgcccgcttttcaattcgtatttatcataacgattgtaatggtcggtatgaatagaagcaaccaaagccgatttatcggaaatcgtatagtctattgtgcccccataagtatagtcttctgatttttcgaaaatgttatctgcttgaaaatcatacttgtttagcatataatagcttccctttaactggaccttcagtcgtttactgaaacgataatccattttatgggttacttgcacgtcttcgtatcccgatatgctggtgggagttgtgttgagttcttcggtaattgtggtgttataggccgggaagaattttaccaacggctttttgtcatataattgatatccgtcgaaacttttataaagtatatcggtgttcatcgtgaattttcctaagtttaatccaagggataaattggtgttcagattgggtttatctaaatgggtccggtacttgtattgtgaatggtccttgggggtatctttataattttgctggttttttcccgcataacgtatccctgcggaggcttcaaacttctttttagctttacgggtaatgatattgatgactccacccatagcttgtgagccgtaaagggcagaagaggcccctttgactatttcgatatggtcaatattataaagattgattcgtgaatagtcaatgttgccaccgttttctcctgctatgcgttcaccgtctatcaggaaaaggatatgtttggagcccaagccctgtatgtcgatactggttccataaccgacttcctgaaaattgagtccgggtacttcctgggtcaagagatcctggatgttaccggttcccctttcttctatttgttttgcgttgattacctgagtgataaccggtgtattttttatttttttttcagttcgggtggctgtaaccacaatttgttcaaggttgaaaggatcatcattcatataagaaactgtgtccttttcttgccgtacattctgtgctgctaaagggagtgcacctataaaagtcagtagtaatgcaaattttgttcttatcataatctttgtttttggatcagcaaagatatagggtacttaaagagtgtgaaatacctaaaaataggtaaaagacagatgacgattaatactaattccatcgaaataattagttcagcttccggatggcttttctcacctcgcatatcggagggattctgccgcttctcttaaagaatttgcaggagatggtgtaaggagtggaataaaaatcgtatttttgcaaccaacttttttaaaataaccggttatgaataccattcagataaaagataaactattcactgtttctatcaaggaacaagagattcaaaaagaagtgattcgcgtggcgaatgaaattaatcgtgacctggcaggtaagaaccctttgttcctcagtgtgttgaatggttcgttcatgtttactgccgatttgctgaaacatataacgattccctgcgaaatttcatttgtaaagttagcctcttatcagggagtatcgtctaccggtactattaaagaagtgatcggtatcaatgaagatatagcgggacgtactgttgttatcgtagaagatattgtagatacgggactgactatgcagcgtttgctggaaacactgggaacgcgcgggccacaggaaatccacattgcttcgttgctggtaaagccggataagcttaaggtggatctgaatattgaatatgtcgcaatgaatattcccaatgatttcattgtaggatacggactcgattacgacggtttcgggcgtaattatccggatatttatacagttatagactaacataaaataaataataggtataccagtaatggtaaaatgtagaattataaattaacaagatgctgaacattgtaattttcggtgctcccggttcaggaaagggaacacaaagcgaacgtattgtagagaaatacggaattaaccacatttcaacaggagatgtattgcgtgcagaaattaaaaacggcacagagctgggtaaaacagctaaaggctacattgatcagggacagttgattccggatgaattgatggtagacattctggcaagcgtattcgatagctttaaggatagtaaaggggttatttttgatggtttcccaagaactattccgcaagctgaggcgttgaaagtgatgttgaaagaacgtggacaggatatctctgtgatgctggatctggatgttccggaagaagagttgatgactcgtctgattaaacgtggtcaggaatcaggtcgggctgatgataatgaagagactatcaaaaagcgtctggttgtatataatacacagacttcaccgttgaaagagtattataagggcgaaggcaaataccagcatatcaatggtcttggcaccatggaaggtatctttgaagatatttgtaaagcggtagatacattataattatatatgtgctgatgtgctcattaagaaaatagcatggattatgggtatgtcggcacatgatcacattgaaaatttattgattatggctgaatcgaattttgttgattacgtaaagatatactgccgctcgggtaagggtggaagaggctctacgcacatgaggcgagaaaaatatactcctaacggtggtcccgatggaggagatggtggtagaggaggccatgttatcctgcgtggtaaccggaactactggacattgcttcacctgaggtatgaccgtcatgctatggccggtcatggagaatcggggagcaagaaccgcagttttggtaaagacggcgcagataagattattgaagtcccctgtggtacggtagtttacaatgccgaaacgggagaatatgtatgtgatgttacggaacatggacaggaagtcattctcctgaagggtggccgaggcggattgggaaactggcatttcaagacagctacccgtcaggctccccgttttgcccagccgggtgaaccgatgcaagaaatgacagtgatccttgaattgaagctgttggcagatgtaggtctggttggttttccgaatgccggaaagtctacgttattgtcggctatttctgcggcaaaacccaaaatagctgattatccgtttactactttggagcctaacctgggtattgtgtcttaccgtgacggacagtcgttcgtgatggcagatattccgggaattatcgagggagccagtgagggtaaagggcttggattacgattcttacgtcacattgaacgtaactctttattactgtttatgataccggcagatagtgacgatatccgtaaagattatgaagtgctgctaaacgagctgaaaacgtttaatccggaaatgctggataagcaacgggtactcgcagtcaccaaaagtgatatgctcgatcaggagttgatggatgaaatagagccgacattgcctgagggaatccctcatgtgttcatttcgtccgtatccggtctgggtatttcagtattgaaggatattctgtggacggaactgaataaagagagcaataaaatagaggctattgtgcatcgtccgaaggatgtcagcagactgcaacaggaactcaaagacatgggagaggatgaagaactcgactatgagtatgaggacgatagtgatgaagatgatctggattacgaatacgaagaagaagattgggaagataaatgatttcactcaccgacgataagaaaatgttggggtatgggctgttgggcgcataccccaacatttctcattttgtgacgacccgacatggaggttatagtgagggagcgtatgcttcttttaattgttctccttactcgggggatgaatttgaaaaagtaaaaaagaatcagcttttattgtttcaatcgctaccgcaagtaccgaaacatctgattctccctttccagacgcatggaacaaaagtgcttctgattaataaggattttctggagacttctatagaatgtcaacaggaaatgctgagcgggatagatgcattgattaccaatgaaccggggtgttgtatcggtatttcaacggcagattgtattccggtactgctatatgataaagtacatgggggtgtagcagcagtacatgccggatggcggggaactgtggggtatatcgtgggacacacgcttgagaaaatgcgggcggcatttggtacggagggacgggatgtgattgcatgtatcggcccgggtatttctattcaatcattcgaagtaggggacgaagtttatgaagcttttcgtttgaatggttttgatatgtcgcgtatctctttccgacattcggttacccataagtaccatattgacttatgggaggcaaaccggcagcaactattagactttggtgtgccgggagttcagattgaagtagcggatatctgtacttacatccattatgaagatttcttttcagcgagaagattaggcataaagtccggacgtattctatcgggtattatgataaactgctgatggacaaaattttgatttattatgtataccattactatatcgaaagagttaaaagaagcatctcctgtttttgcaggagctgctgtatatgctgaagtgaaaaacacttcttattgtgaaggactttgggaggagattcaatcttttacagaaaagctcactacaacaacccagttggaagatattaaaaaacaaccagtgatagctgccacacgtgaggcttacaaacggtgtggaaaagaccccggaagatatcgcccatcggccgaagcattacgtcgcaggctgatgcggggaattgccttgtatcagattgatactctggtcgatttgatcaatctggtttctcttcggaccgggcattcgataggtggttttgatgcggataagatagcgggcaccaatctggagctggggataggcaaaaaagaagagcctttcgaaggtattggccgtggagtactgaacatagagggacttccggtataccgcgatgccgtgggaggaataggaacacctaccagtgataacgagcggacaaagatggatctggaaacgactcatatattagccatcgttaatggttataatgggaaggaaggattgcaggaggctgccgggatgatacagactttattgcgaagatatgcaggatcggacggaggaacgatcacctattttgaataacaagcgtccatgaagaacatacacacttttttgattttatctctgttttcgttgtgtacgagtgcacaacgcagtgcacaaaccaaattctcggatatggaggttaatcatgtccgggtggctacaccgggactttttgctaaagagaattgcatcatgctcgatctgaattccctgtctcggaattactcttttcctttgccgggaggtaaagtcatttccggttatggaacccgtggcggacatagtggggatgatataaaaacttgtgcccgtgatacgattcgcgctgcttttgacggagtggtacgtatggcaaaaccttatggtgcatacggcaatgtgattgtgattcgccatcccaatgggttggaaacggtgtacagtcataatgtgaagaatctggtaaaaagcggagatgctgtgaaagcgggaaaagctattgccctgaccggacgtaccgggcgggctactacggaacatttgcatttcgaaacgcggattaacgggcaacattttaatcccggtcttatttttgatatggataaacgcactttgcgcaaggattatctgcaatgtacgaagaaggggaaagggattattgtgaaagctttgaaaagcaaaaaagttccccctaagtataaaactctttcgcctttcctttatgaactgcccggtattaaaaaaccggaatggaatataccaggcctagcgaaatccgctgtgtattcgggtctatagcttctaaacggcgggcagctttcaggagttcgttccgtttgtactgataatggaggaagatcaatagttcgctgtttcgcatcggatagtattctacgcaggcttgcccgcaccaggtacgacgataggtgcctttctcaaagattccgtttgttttataaatcttaccggtttcgtagatacctttcaagtatacattccaattgggatggagacggtagtccacattggcaatggtagtgaagtattcggtatattgggccgtttgtggattctccagggcagtgtggggtaaggcactgataatgcctttgttgtcgatcccctgtcgggagtacatcaaatctacataagcgatccatggccctttttcatagacgtttccggcagtgagatacaggatgtttcttcctttggcctgctgtccccatgaagcggcatatcttaactggatggctttatccagatagtaactgttccagttgatagttgagatcaggggaactttggtagcttctacatttgccggtagcccgtggagataggtatcttcatccccaccattacggttgtttactatctggaagttcaattcctgagtaggggttacattccaggtggcagatacacctgccagaaagcagttgacataattattaaactcactgaactcacgcactttaatcgggttgacatagtattcgtagccacccagcatgaggaactgttttccggcggtgatggaaaagcgttcggagaggtgataggtcagataagcatactctacggaagaagacaggttgtccagtacaaagggattgctgtatttattaaaagattgacggaaatggtaagagaacttttggttgatatttcctacaatttctaatttgaaccgattaagtttgaaagcgacctcctctaattcattctcggtaaaagaagcagcacatgaggtgtagagttgcaggttcatgtgagcggagaatcctttgttttcttttccggtgatgcgttggactacagaagaaatagagtcgtttggggaaataatgggttgctgttgggccgtaatggtacccatggtaaacaaggttaccaaaaggaagacgtgtcttttcatatttgtgaaatctctttgggttaataaaagtgatgcaaaaataataaaaaacgtcttccttttcgtcttttcaaggtaaaactgtctgtttctccttaaagttcctgttctgttagtctacaaatttcaggcaaacaggtttgtctacttttatatctttcttgatatcggtcaatagtccggtagtctggttcctttcaaatatctgaatggtattggtgtcgcggcacgctaccagcaaatatttgccgttgggggtaatgatgaagttacgcggatggattcccgttaactgataacctatcttggtcagggtaccattggtcttgtcgactttgaagatggcaattccgtctgctttcaggcggttgctggcatagagatattttccgtccggactgatgtggatatcgccactgccttgtgcatttacagtatcggctgcaatggtttgaatttcatccagcattccgtcggtataccggaaagctattaccgtccctcctatttcattaataaggtaagcaaacttgctgtccggactgaatatcagatgtcggggaccagaacccggagcaaccttaaaagcttccggattaccctttgtcaggagtttctctttgttatcggcataggcattcggattgagattgaatttatgtatctgatcggtacctaagtcatcggcgagtaaatatttgccgtccggagtaatacgtacgcagtgcagatgaggcattgtctgtcgttctttatccggtccggaacctttaaattcgattacatcggaggcgggtagcagagaaccgtcttttccgatgggaaagacagtgatactccctccgctatagttggcagtgataacattctttccgttggtgatcaggtagcacggatcggcccccattgttttctgagtattcaataagcgaagcgttcctttggttttatcgaaagcaaaggcgctcacagatgcctggtctttgctgaattcattgacggaataaacgaattttccgtcgtccgacggaacgaggtatgatgggttagcaacttctgtatcactgagtggtactgatgctccggtttcttcgttgaaccggaaagtgtaaatgcctttactgtcgccggaagtatatgttcctaccagcataatcagttcgttgtcagttgttgttggatctgccggctgtgcggttgtcttctttggagaacaactggctacaagcatgccgactgcacagatactaatgattttttcgaccataataaatagatgttattttgagggtttgttggttgccttcgttatattctgaaaacacaaagttagtataatctcctgtgtttctttccggaatgaataaaatatctaaaatccatcctctttttctttctttatgatgaatattccctatctttgcagccacataagtggttaccacttcctcatctcaaaaggggttgactggttttgacagcgggcagaaatggtgggtaagcatgcagtgcgtcggtgatttgcactttaatctcagttatcaaaattttatctggcgaaactaattacgctcttgctgcttaatcgaatcatagtagattagcttaatccaggcaccaggtgccaggacgagacatcactcggaagctgttgctccgaagcattccggttcagtggtgcagttacatcggggatagtcagaagtggcctcgcgcttcggatgaaaatttagaggataaggcaggaattgatggctttggttctgctcctgcacgaaaaacttaggcaaagataagcatgtagaaagcttatgatttcctcgtttggacgagggttcgaatccctccagctccactttatgacagaaacgtccctctgaaccggtaagttcagggggattttttgttaagaatatccggattgtccgggttatttgttacgttctcaacgtaagtcgttgataggtagctgcctatcggcatttaaactgctgttatttgtccgggtactttattttgtcttttaaaataaacactctacatttgacttctgagcaattcgtcatagagagtcgacaagtgagaaacggtctaatcccaagtatggttaaagaaattattgtctgctcatatttattgtttattcatattccggtaaatgcccttgccaatctatctttttcttaataaaaaccatattggggaaacaaactgaatattgtctcgttataatgtagatcagattgatttttcatgtgagtcgcctttcttgatgtcctgttgctcaccgataaacgatgtgaacatctcattactattgttttgttagtatcctctacgacaacagggagggatttaaggcgttcaggagcgccacaaatccggtcacctactcacgtgatgtgcagaaggtagtgtttttctttcccccatgactaccttactatagggttcccacttttaataaaactactccattttaattataacaaacaaaaagaatgaaatatattttatacttcatgatgatgatatatggttcgttatgccatgccatcgtttgcaaacacattgtagaaataagtgaaacgaatactcgtaaagtgcatcagatacggagagatgccttgggatatatgtggtttatgagccataccggaataagccggtttgatggaacgaagctgaaacactataagttgtctgccgaaggacagactgtggattattatatgggctgttgccggctgcttacggacaaagagaatgggttatgggcggttacccgaaacggagatttatggacgtataatccgtcattggataagtttgagtgcagaaaccatctgccgaaccaggataaggcgtcagtgcgctttctctgtgcagatagtcaggggcatatctggttttccgctggaaaccggttgattgcttatcggggaattactaatactttctatcgggtgaatcacaatctgaaacagatttccggtatggtggaagtggctccgggagagtattttgtgggttcggatgaaggtctgtttgagataaccatgaagggttattccatagaaaaacaatctggcgaactgtccgggaagagatgtcgccggatacatgaaatgctttttcatccgtatagcggcagactgattatcgcagactattcggaagggttaatggtgtgggacacgaagtcggagcggatgatttatacatgggacaggcctgtgaacagccggattagcagtttgcgaacattggacgaccggaatatcttagtagcaacggacggtgaggggttatatcgcatggacattattaacccggaaatcaggtcttttgtacataccgattttgagaatggcaattcaattcgtacgaaccggattgccgatttgtttgtggatgatcagaaacatatctgggtggcggattatccggaaggcgtatcaatgattgatatggattctccggatgattataagtggtataggtttcaggcaggaaatacgcattcattggcgaacaaccggataaatgcggtattacatgattcggacggggatgtctggtttgcgacggatcgtggtatcagttgttttcacccgtcgacaggcagatgggaacggattgttacagatcttccttgccagatgtatactgcacttagcgaaacaggtcccggagagatatgtgccggaaactatgtacacggcttgtacatcatccgtaagaagaataataatcaggttgttccgtatgcccgcatttccggggtcaatgcactttgccgtaaggataaagatcggttgtggattgggacggatgaaggtttgtttctctattgtcccaatgataatggtgttgtagaagtgaaatccttgtccggtctgcacattcatgccttgtatcagtccgatagtaattgcctgtatattggaaccgaaggaaacggtttgctggtctaccgtccggagcaatcccggctggatactgtgaaaaattcaggagttactaatgtgtacgctgtttgggaggatgacaagaagcggctgataggaagcagtgatcagtttgccttttcatttgatcctgtacagcattcgtttcggcggtttcccaataaaggactccggattacgtcgggagcttttattggagacggcaggcagatactgggtacataccagggagcaattgattatgacaaacaagagcctcgttcgttacacaagacctgcctgggattttatctggacgggcttcgggtgctggataaggatatgaccgtagaaacagaaaatactccgttagaaaaagcactgaattatacagctaccttacagttggatcatgatgaaaacactttttcgtttacggctactgccgtccgctacgatgaaatacaggatatagcttacagctggaaactggataatacggactggagtaatccgtcgccggagaatagaattcgtttttcgaaccttgctccgggtgaatatgtcttctccgtacgggcaatatccattggtaacggacgtccgtttgcacagaggaatatgaatatcgtgattcgtaaaccgctctggaagacaaatggcgcttttctttgttatggagttttggctattacgctggggtctttagctgttcgttcatggttcatctggcaagacaggaatctttcaagagaaaagatacaattgtttatgaatactacccgtaacctctgcatgccgcttacgttgataaaggttccgttggagtatctttatgaaaaatcgtcttccgaacttgtcaataacgtattgcaacagattaagggtgtaaacaatctgctggccgacctggaaagcatcagccgtatttcggcttctcccgggtgcctgtctcttgccgatcatgagttatccatgtttctcaaagagacggtgaaccgtttcagtgattacgcaaacgaaaaatgtattacgcttcgttgggtggacgagccggcttttgttaccgtgtgtctggatagggagaagatggctgcaatcctccggaaccttttgatggcttttaccgacagtatagacaggggcggggaaatacttctgagtacatcgtgcaatactcaaaactgggagttgaggctggagtctgaagataatggacttcttaaaaaaaaattctaaattataagggattggtttcgggaggctctgccgagaccatgagttggttatttatacgcaaattaatctgtttgcataaaggcaaaatcaaatttacttataaagaagagcataaactggttcttatcttagtctttcctgttgctatccggcaatcggagaaattttccgacctttccgatctgctttccgtacctgaatttccgaccaaggacagcgaactgttaccggctaacgaaacgttgccggcaatggaaactccattaccgaaacatcgggagaagagacgcaacggacgttctttggtattggtcgaaacccataaagaattacgtaattatcttgtgcgaatcctgatgccggattacgaagttgtatcggtttgcgatgcggaaacggcctttacgactatatgtgaacagcatcccgatgctgttctggcctcttcagcccttgtcggaatttcgggggaagaacttgctgtccggattaaatcggatgacagggtagcacatgtacctgtgatattgctcgtgaaaccgggcgaagacagcaaggagacccaacggaacgccgatctttatgtgacaatgccttttgccatttcgttcttaaaagcagagattgaaagtctgattaccaaccgggagattatccgcaagaggtatatccgtttgacattaggggttgatgctccggatgacgtcgaagccgatgtgccgttgtcggatggtgatcaggaatttatcagtctggtgagaagcctgattgaagagagactcaccgattccaggtttacgattgacgaactgagtgattgtgtgaatatgagccgttcgagcttttacaataggattaaggagataaccggccatgcacccgcagactatgttcgtagtgtacgccttaacaaggcgctgatcttgctgatgagtaggaaatatactgtagccgaggttgccgacatgacgggattcagtgatccgaaatatttcaggatcgtgtttaagaaacgtttcggagattcaccgacaaagtatataagcaatttgtaagttaacgggagaccggccgggggagtgccttgccggtcttcattttattaactaatcctgtcagtgggattgaaagaataactcttatctttgcttctcaaaatgtgaactgcgatgtagaattattgcagaaatgggcgaacgtaagattatacatattgatatggatgctttctatgcttccgtagagcagagagaccatccggaattgcgtggtaaaccgcttgctgtcgggcatgccgaggagcggggagtagtggcggcggcaagctatgaagcgcgtcggtacggagtgcgttcggctatgtcgtcacagaaggcaaagcgcttatgtccgcaactgatttttgttcccggacggatggacatatataaatcggtttcccgccgggtacacgagatctttcatgaatacaccgatttgattgaacccctttcgttggacgaggcattcctggatgtgacagagaataaacagggaattttactggcggtagatatagccagggctattaaacagcgcatccgtgaagagttgaacctggtagcatcggcgggtgtatcttataataaattcctggcaaagattgcttcggattttcgcaagcccgacggactctgtaccatccatcccgatcaggcgctcgatttcattgcccgtctgcccatcgagtcattttggggagtaggaccggtgactgcccggaagatgcatttgctgggtattcacaatggccttcagctacgtggctgttcgtcggaaatgttggtacggcagtttggtaaagtaggactgctctattacgattttgcacgaggagtcgatctccgtcccgtagaagcggtatggatacgtaaatcaatcggttgcgaacatacgttggagaaagatattcatgtgaaatcggctgtgattatagaactttatcacgtagctacggaacttgtggaacggttgcaacggaaggacttccggggaaagacgctgacgctgaaaatcaaatttcatgactttagccagatcacacggagcatgacgcaggctcaggaactgacgagccttgaaagaattctgcctcttgccaaacagttgctgaaagaggtggagtatgagcaacatcccattcggttgatagggctttcggtgtcgaatccgagagaggagacaaatgagcatcggggagtgtgggaacaattgagttttgagttcagtgactggggaaaatagttaaagatcgggatgcggggatgaaatagtcgggtgattgtatctgtttagtattatttttcttatctttgggagtgatacggcattgagaactaataaattataaaagatcatgaacctgagcagatgtccaattctcttcttgctactatttgcgttgttctgtagttgccacgatgaagacagggaggatatacctccgaccgacgaacgaaccgcgaacttcattgtgaaatataacgacggatccggaatacatccggattataatgctaaagtatatatttattatggaatatattcgatggatattgcaggtttccgctatcttccggatggagttctggaatatcgcggacaggaaatagttcctgatatagcattgtctgctgatgggaaagaagatgtgtcactgttattaaataacacggagaaggtaacggtcgtggttgagagttccttttatgaagggaaaataggaataacgagttactctccgggggatatgtccataaaggctacatttatatttgggggatagtatggtggctcgggacagccgcctgaatgtctgtcctcgttttatgatatataagaaaggggagaagccgaaacttctccccttctgtatagaggctctgtttgctatgaacagagcctttgtttggtacggatagagcctctgttctgcttctgcagagtctctgtttccggcaagtgcttacttcattcgttttcggagcaaccggctcccggtgcttttcccggttgcatccgggggaattgccggtttctccggaaaagccattaaaagctgccggaatctgtttgctacaatccgtgtatcgctttcatcagttgttctcccagtccgatggtatagccttgtgaaacaaaaactacccggttgaacgtatcaccgataataaacatcggcaagatggtgctgttaggcaatttcatcgattcggcaatttgtttctggatggctccgtttacatcgataccataggtgatggtcgagggcagtccggggaattccgtcgggcggaacttcttatattgttcttcattagggaaaagcagtaccattttgcggccccatttttcgaattcgctgcttagggccgcaatatcccggagagcatggtttgtcggttcttgtccggctcccaacacggcaactacaaaatatccccgtccgcaagtctgaagaatgctttgcggttcggtggctcctatcggcaggtaggtggattcggagttgaaattaccgatcacctgcacctgatccttactttcgcgcatcaccagatcgacagttgttgtctttccctcttcgatggtgaagaaagtgatgttggccaacactgctccacttgccatacgggttccggttaccatcatgtagtatccggtatccatgcgggcgccatttttcagcaagttcgaccaggtggctccgccgcccatatctacgtccccttcatcgtagttcagcaattggaaagtcccgttgcggaatttcgagagagtgaagtgtgaatagtatttcggatcgctcaacgaagggataggctggtagcgggctacgagtgttccggtcggtgcctgtgtctgctgtgctgcttcaaaatccacgtcgtagactttaccgttctttagatcgttgtcattgaaactccggtattgaatttttccggtcacttcgtctatccaggcggggatacccagactacgtgccatggatacaaagaaaatgttacgggacttttcgtctgctacccgggctttccatactcccattggagacatcggaatacgttgtgagttcagttcattgttgatagtgatctcttttctgcaccattctaccaaagcctgtggattctttcggaaagcttccgcttcagttgccgggatctctttctggaagaatgctttgtagggagtgatcatttcgttggccacacgagggttcagtacgttgctgtagaagtcctcggaaccgggcagaccggagttgttcagatgatcgttcagtacttccggactaacgtctctcaggtccttggctgagattactttcagcaagctgatggcctgactggctttatcggcttttacggcagcagaaaggaaatctgtcagagtctgatggttacctctggaagctatcagtaggcgtactgtttcggtttcatccagcttgttctctttggtaaaagtccgggcttgctcttcggtaatgaaagtggctacgtaagcattgcggatggaatcttcctgtgccatgcggcgatcgttttcagtacgttgctccggagtcacttcgggcaggttggcaccttcggccggaggaacaatatccagtgggagtgaataggtttcaccggcgttcttgtccagtgcgatcttcagttcgttatctttgccgaatgacaatttggaataaccgaaccgtccgtctttagaggcccataccagcatatcgcccttgccggcagtcagcgatgcgcgtcctgccttatccgtatgtttagtggctacggtgtagaattcagcataattatacaccttgaactctacagtggcatcggataccggctgcccttcggcatctgtcaccaataccgagcctttggctgtcggggcatagttgtcgattacattgatttccgtatagttcggagtttcgtacatgatttcctcttgtccggcatagcgtccgaatactttggtatgcatcagcatgccacggctggcaggagcattaaaccagcccaggttcagtaccggttccggttcgcaggcgccgaagaagtaccatttaccatctacccaggcttctacccaggcatggttatcgtcggtatgcgcccaacgcggagtataaacctgccgtgccggaatgcctaccgagcggagagcggctacagtgaaggtcgattcttcaccacaacggccataggcggtctttaccgaagcgagtggggaactggtacgggcatcgcttggggtgtagactaccttttcgtggcaccagtggttcacttcaagcacagcgtcgtgcagcgacaggttcttcacacgatctttcagttcattgtaaaatacccggcgcgagtcgtccagattttcgttgtttacccggatagggagtacgaaatggcggaatacgtcatcggggatctcttttccccaaggcatttcgcgacgcgcctgatcggagagtctgacattctccagatagtagtcacctgtataatccgtcacgtcacctgtgggcatataggcatagaggaacatcaaagcctcctgttcggaagtggtgagtttttcattgaacactgcgaacagatctccgttagggagctgttgcttcttcttttcaaaatcttgcgtcacttggctacggtaagtctcatctttcaggaagtgggactcactgcatgaaaaaaacgcaaccgacaacatcgggatgattagaaagcgggtcagggttttcatacaatttgttgttaaataaggcttcgctcctttttctctcccggagagaggggaggagtgaatgctgttggtttatatatttgattatgatttctttttttatttcctaaaatccgttcatagggaagagtactgtggggatcagcaataccattcccagaatgatgaataaaagaagtactttccagaaccatttcacccatatctcgtaggggatgcgggcaatgcccaaggctcccatcaatacggcggaagtaggtgtgatcatgttggtaaatccgtcaccaaactgataagccattactgtagcttgccgtgaaagcccgatgacatcggaaaaaggtgccatgataggcatggttaatgcagctttggccgatccggacgggataatcaggttgatcagtgtctgtatcaggtacatcacccccaaagatactatttttccggtttctcccatcagtgaagccagagaatgtaagatcgggtcgatgatatgtccgtcttgcagtatttggatgatccctcctgccagacctaccacgatggcagctgatagcatatctttggctccgtccatgaattgcccgatgatgttatctgttttttcactgttggcaaatcccgagagaatacccattgcgaggaagatggcggagatctccggcagataccagccatgtcccatgacaccggtaatcaggaaaagaatggtgaacgcaagcagggtcagtatgaagaactggttggatttacgtaaacccagccagccgaaggcggcaaacaaaacagacaggacgggcactgcatagcaggtgacagacgcttcgcctattgcgaaagtactggttgggtaaatgatggaaaacaggcacaaggatatgattaacagtatgtagacgatccatgccggacgagtcgtgacacgggatatctctccgttgctttcttcttcccgtttccgccaataagcatcggcatgatacatgggcgatttctccggatgctttttaatgacggcggcatatctgagtacacagactatcaggaccgtggtcagtatcagccagcaaagcatgcgatattcaaatccggaaaatagcggtaagtcggacaagccttgtgcaatgccaatggtaaatgggttcagtacggcacccgaaaaacctatgtgggcagcaacatataccatgcaaagccccgtgatggaatcatatcccattgaaatggccaacgggacgatgataatgacaaaggccagggtttcttcactcatgccaaatacggagccgaagaggctgaagagaataatgactaaggaaatcaccacattgtttacccccaatgatttaatcagtctgtgcttttcaagccccttcgtaaagttcaggaatgaaaagatgccggtatcgatggcacggctgctgttcattatctgaaaggcacctcccatgatcaataagaaggcgatgattcccgcttgccgttcgaagccttcaagaagagcgctgaacacttgccaggtctgtggcgtctgttctacccgatggaaagagtggtctataatgactgtgcgggaagtgccgttgacgtcaatggtctcgcgcacatattcacctgcgggaatgatccaggaaagcactgcacagagcaagatgacagaagaaatgatggtgtatgtgtgtggtatccgttttagcatagtcgtttttcttgataaagcgcaaagttatgcaatatatttgtaatatgcacttgccaaatctgcccatataaaaagaaaaatcaactaataacacacttttcttatgttttagaacatgttttcgaaaacatttcgtatctttgcagtgttaataaagaaaacaagatgtaaaaccgctcttcaaaacgtggggagcaaaaaaagaggaccaaaattatgaaaaagaatgcaaatgaaattatgatgttgcagtaccgtatcaaacgttaccaagcaatgggaaatggaacaatgtgccagttgttgaatggcaaacttcaaaaactgcttgcaaagcaggttaccatgtaattaaacacacctatattatatgaataagaagcggggaatcggatgattctctgctttttttgtcatttatctgtctgtaccgggaacaatcattataaaatattcgttaattaaacaacgaatcctgttttatctcaaatttattactacgtttgcggtcactatgataaagtacgtattctgcatattgataggtatcttcttaatgtatggagccggttgcacagcccctgcagaagagaacgcggaacttcctgcgggagttactgcaacctttatatcgcaatgtgccggagaccactctttattcaacgaccagacggctgactcgaaagtgagtgatgccatccttccccacggttctttttcacgggaactcggttcatccaaagtattaaaacttaaattacagactgccatccgcttgcttaatacctttcatatccgccagtcggagaagggagatgcttatccggatttcaatcataacttcattaaatattccagcgggtattatgtatactcgttagggcatatcctgatttagcttttcggtttcacacttccgtattgaagtgattgggtaatcccatttatctgttccgataaatgccggggaagtgtgtcttgtctctctccggtagtcgtcattcgttgcattttattttttcaatctaaaatcataccatgttatgtttagtttattgttatccacttttgccatgatggggcttaccttcgtcattggctttttcgttgccggagtaataaagctgattgcttctgcggctgattcattggctttctacagttcacatcaggaagagcttgcccggttgaaacgtattcggaaacttcatcagaaagtagctatcttgataaccgaaagtgcccttagcgacgaggagtacgggagtgacgggcgtgaagacttcagcaggggcatcaccaaacatcccggagacaatcgcgggttctatcacggtgtcagtcccggtgagccggaacgcggactgatggattatttttatccggaagatacaagatccatgtttcttcgcaaagaagaacaaatgttacagcatgacaaaaagaacaataagaaagcatcttcaatcaataaaaacaaataaatcttgatagtatggaaagtatagactttggaaccctgtttcagggatttggaacaatgatggccagcggatggtttctggccagtgcccgtatgtttttaatagctttgggatttctgctcatctatctgggctggaagggtgtacttgagccgatggttatgattccgatgggactggggatggtagccattaattgcggaacactgattatgcccgacggagcattggggaacctttttctggaccctatgttatcggatacggacgcgttgatgaatacgatgcagattgactttctgcaaccggtatatacattgacgtttagtaacggacttatagcctgctttgtgtttatgggaatcggtacgttgctcgatgtcggattcttgttgcagaaaccgtttgccagtattttcctggccctttgtgctgagttggggactttccttacagtgcctatcgcttcgggtctggggttgtctttaaaggaaagcgcttctgttgcaatggtcggcggagccgatggaccgatggtgctgtttacttcgcttgccttggccaaacacttgtttgtgcctattacggtggtggcttatctgtatttgggattaacatacgggggatatccttatttggtaaagctgttgattcctaaacgtctgcgtgctatcaagatggtggagaagaaagctcctaaaaattatgacgcgaaagtgaaacttgccttttctgctattttgtgcgctgtgctgtgtttcttgtttccggttgcttctccactattcttctctctcttcttgggggtagctgtacgcgagtccggcatgaagcatatctatgattttgtaagtggtccgttgctttatggttctacctttatgctgggattactattgggtgtgctctgtgacgcccatttgttgctcgatccgaagattctgaaacttttagtgttgggtatgcttgctttgttattgtcgggtatcgggggaatcatgggtggttacatcatgtatttcattaagaaaggaaactataatccggtgatcggtattgctgccgtgagttgtgtgcctactacggcaaaggttgcccagaagttggtaagtaaagataatccgaactctttcatcctgggggatgcactgggtgcaaacatttcaggagtaatcacttcggctatcattacgggtatttacataacgattataccatatttataataatgttgtagctgacagaatgatttcatgagtgactgacagagcttatccatttacagtttgtatatttgtcgctctcagatagtttgaaagacaaggttatgaaaaaacttatccctcgatatacctttttaaagaataagtacggcagtgagttgctggtggatatagtagaactgaaagatataaagaaatatgtcgttaaaagttctgttcataccctgacttattatgacattacctttatcaccgaaggggaaggaagtttcattcttgataatcatacctaccggggcggtgtgggagatgtgttcttctccaagccgggagagatacgtagctgggatacaaatgcgattgtgaatggatatgctctgatatttgaagaagagtttttatcttctttctttaaagattctttgtttgtgcagcatctttcctttttcaatccggtgaaggaatcgttgaaaatacatttgccggaacgctcttttctgcgtatgttgcaacttctgcaatctattaaggaggagattgatctgttcagacagaatgacgttcatgtgttgagagcgcaactttatgaagcgttgatgctgcttgaccgtttttacgtgcagaccgtatcggatgcagggataaacaaggaaggacgcagtccgtatcttgttcagtttgtacagttggtcgaccgtgggttcagtgaatatcgtaccgtgcggtattatgccggaagactgtgtattactcctaactatctgaatgaaatagtgagtaccgctatgcagataagcgccaagcaatatattcagaataaagtgatggaagaagcaaagcggatgcttgcttacacggatttgccggttgtcgaaatcgctttcgaactgaattatgaaacggtttcttatttcagccgttgttttcgccggtatacgggagaaactcctttgggctaccggaggggacataaaccataaaaagtgtcatttctacctttgtttctgtcacataccctctttttcctttctgtacctttgtgtcagtgtaaaactattaaaatttagagcaatgaaagatgtagagaaaacgattgggaatctgattgataagcaaaagatcgcatttatcggatctgttgatatagaaggcttcccaaatattaaagcgatgttacagccccggaagcgtgaaggtatccggattctttattttaccaccaatacctcttctatgcgtaccactcaatacctgaagaaccagcatgcttgtgtctacttctgtgactctcgcttttttaggggagttatgctgaaaggtaagatggaagtgcttacagataattccaccaaagaaatgatatggagagaaggcgatacgctctactatccgcttggcgttacagatccggactattgtgtactgaagtttaccgctatcaccggcaggcgttatggaaacttcagttcggaagattttgaggtagagtagcttgttctcaatcttagaagctgattgaaaacagtgcttctacctggaattttccatagtcgatcggctggatcagccgtacgcctgtcgtgagcggataactcatacgtagcacattccaatcgaaaataagatcgcctccgtaagagctttgtgtgctccagttacttttacgactggcttggttgcgtgacaagtcataaaaaagatttgtacgcagcctgcgtatgtaaatcagtgaactgatgcttaggtcgggcgaaagcaggggtaaagcataatctgctttgaaggcccattgttggcgggtttgatattggaaatgatatccgcgaggcttttccagcagatgtttggggagatacagtgatttattgtcaaggtcttgatattggtaacccaagcggagcatcaatccgtgattcctgatgatacccggccaataggtagtcagccggacagcatacaaactgccgaaattctccttattgaacggggttttcaagtattgcagccgaagctggtaaccgtttcggggaaggatgtcgcgttgtgcttttcgtctgtaatcataaaataggatttccgggagaatgtattggaagttgcgatactttccactatgatactcctgatacttattgtttgtgaaatagtaagtaaaagcaggctgtatgcctcgtatgcgttggttacgtgtcaggttgaaagggaggtaaactcgcgcttccgcttccagtagattgcgtccgggataatatcctttggtgatatcctgacctttgtcatctttggtccagccgatattgaaagccttatcaccatagtcggcagcaagattgattatagggaaccagccctgataggtgaatgacagtttaccgtgatggtagccttcgtcataataccagccggcctgcatgatggcggtgttcagtgtattttgtgacataatggttgctcccggcttgacaattgcacttaaatcacttgcactgctgttcattgcttcggccacatcataatagaaaggtgcccagctgtgtatcttgaaagtatgtgtacctttatgatagcgtttaggggtgaaatcgatgctatccagacgggcagagtcaaggttgaactgttcttgagcagccaatgtttcaacgaatggcatcggagcaggacaggctaaatcggccttttcaaatagtaagctgtcagtcggcaacgcagcaatccggtatccgtctgcttgataatcagcaaaaagcagatggttgcctgactgggaaaatgaaggatcgaatgcaccgaaacgagcggctgtcagccgataaacctgtttgtcggagagatgaagacagtagatattatttgtgccgttggctcccgactcaaaaaagagttttccgtctttccaaataggagaggtgatgttggccgaggtggtttttatcaactccttccactctccggactgcggattgaattccaacagactggttcccgaatcggttacggctatggagaaaatatcaaggccttctccgaatgtgagttctttgataaatgcgttgtcaggtacgtcgaaagaggatagctcttttcccttttctgcatttatcaatacaagttggtttttgccttctacagtggggcgggagaccgcaatggtccgaccggacttgtcgatagccggggccagataacgttggcgcggggtgattgtttttatctgctttttatccaaatcataatatttcagaacggaatagttctcgtgcgtccaacggagcccgggaaccaattcactccagtaaatccggttgttccggaagttgagacgactattgatacttccgatataactcagatgcttttctttaccgttgctgatggctaccagagagtttatatctttcagtccggatttgacggcaataattacactgtcattgatcgattggggatatcgataagaggtgtaggtttttgaggtagaagagaggtagtcgggcacaagtgtacaggtatcctgtttttcccattctttccgcaagaaatcgaatgtgtcgtgctgaagccgtttgaaactgcttcctgtgtaatgcttgaatgagccttcaaataataaattccggacataacggctggtacttttatcccagatatcagctccataacgctggcgggcatatgaagccatatcgtagcccaatgcataataagttcctgtataatttttgtaagatcccattaaccacttgtcgaaagtataaggctttccgcctgctaataattgggcacgatagatcatgttgaattccggaagacgtccccgtccgccgtttgacatggcagtttcggtgcttactgcatctccttcgagaaaccacaccggaagaaaaaaggaggccacaccggctgcttgttcacctattatataataaagaggtttgaagataccatgcatcacctttccggtctggaatacgtggcgcgactcgtgcaataccagatgtttatcccagctttgagtacttaggtccgaagaaggagttgtaatcagttccatccgtctcggtgcccaggaaaccattccgttggattgcatgctggccggatggagaatgaccgggaaacgggctttgatcggctttccgatggtcttggacatatggggatatacattttcaagaaagagagcatatcgataggccattgaatcatttccttgcgggtataccagatcatagtgaggcagtttcgctatgttccatttaaaccgggcgggatccgacccgtaatccatgaattgtgcatgaagccggagcggtgccagcaggcaaagaagcgaaagaaacagatattgggattgtaacatgagctgattttaaatagttatctgtcgcaaagctataaaaaaatctcagtctgttctgttaaattcgtttatacatcaagaaattagtcatttctatgccgttcacatcgaccgtttgttctttttcggtgatatatccgtgtttttcaaaaaaaggccgggcggtgatacttacttccgagtgaaccgatacagcgcgacaattgcgggcatactcttcagcttttctcaacagaatggaagcgataccccgatgctgatattggggatggacgaacatgctgtgcagataccctttagggttgatagaggtgaatccggctatttgtgattgtctgatatcttctgctaacagaaaacataagtcactttgaaataattcctgccaacgttgttgagttcctcgtccgatccatgcttgaatctgtaggtgattataatcggcagaacaagtgttctgtacgctttgtgtaaacactgtttgcagcaaacccatatcttggatccttgcttttcgcagccggacaggagggatttgcaggtgtaaaacaggaaatggctttcccgttccgtccaacgcgtcgcggcctgtcacttcaaatcctcgatgtagatagaatcctaatgctgccgtgttttgctcatttacgtctactttataaatgtgtttttcacggatggcgaattcaaccagttcactgccatagccttgttcctgggccttaggactgacaaacagcattttgatacaatcggtgctcagtcccatgaaggcagcgatggttcccgcatcttcacggatgacgtaaagttgtactgcggcaaagtattcgttccggatcaaaggtttataaaactgtatatccgtttcggtcaggaagtggtgggtagtgcgaactgcctcctcccaaacctgaagaagctcgtcatactcgtgtatgtggggttgttctatcattggttatttgttaaaagtcagctttcttttcaatatatattcgttgtccggacatcggatgggtaaattccagacgttccgcatgtaaataaagcctctccgctctcttaccgtagagttcatcgcctgcgatggggcaatttagacctgacggatgggcggagtgaacgcgtaactgatgtgtacgtcccgtttgcgggaagaaagcgatacgggttcgtccgtttttgcgatctattacgcagtatcgggtgacagcctttttacctgattctctgtctgctttttgtctgggcctgtcaagaagatccggacaaatgggaagatcgatggttccttcgtctgtcggtaagataccttccagcagtgctgtatactgctttttaatgctgtggttttcaaactgcgcctgtaagtgctgatgtacttccttggttttggctaccaacaacaatcctgaagttgccatgtccagtcgatgtacgatcatcggtcccgtagcttcaggatagcgggccctgagtagactgtaggcggacagttcttccgattttccaggtacggagagtagtccttccggtttatggataaccagaagccattcgtcttcaaagagaatctctatttcctttggcggggcaggggctgttgccaaaggatccggttcgacatccagaccttgtaacatgtgacgtaaaatgggcccgcattttcctttgcaggacggatagtaataaccgtgacgcctgatttctgttttcggtgattctccccaccagaattcggccatggcaatgggcttcaatccatttaggtaagcatattgcaatagcttgggcgcggcacattcacctgctccggcaggtggtatctgctgaatggtttgttcgaagatagcacacaagttcttgctttctcccctggcattcaaaaagctgaattgatggaatagcttttgctgcaatgccgccgaacggtttttgcgttctgctttgagagattcaatctgcgatgaaatactttccagttctgctttcacttcggaaattcgctctttccaatatctttccagacgtttgaattctgctttctgatattggctttcacgtatcatggcagcttgttcatcttcatccggttgctgctgccggcgctgttcccgtttttcttttgccgttttcagggtctttctcgcttcggtcaatacctgttgtgatgaggctgtctctttcgccagcctttgttggagtttcacataccggtcactgttttgcaattgtccgattcggcggttgatagccgagatttgttcttcttctatcttgaagaaaccatccggttgcaacaaatcgtataccggtggtacaaagaaagagtgtgaattgcttccgcacaagttacccgagaaagcagccagatatcccgtttgtccgttagaagtacggactatcaatacgccgaacatttttcctttgtccaattcttctttccatcttgtctgtttatttatgtaagcctgtacttctcctgctgccattacacataacggatgaggagtgtaatggaagggataagtaaacaagcggggcaattcgatgccggcaatggaggtctggaaggaatgaaacatgctactttattgggtttaaacggattcttgtgtgacaattttcaaaagttcctcgaaagaacttactttatcatatttaagttttccgccgtttacattcgcaaaatgttttttggcacattctatctttgccctttctatttcccggtcttgcagggaagaatcgctggccttggtttcggcaataaaataagggtacttcgataattcttgcttgaagacgatggcccagtccggatggtattttcccatcggagtagggatatagaaacttttgggaagttttacataagcttttatttcgtcattttcttccagtttttccgtgaatgttttttcgtttgtggagtcgaatctcacatgatcgtacagatgtttatctgctttcattgtgtttactcccaaacatccctgaatagctgcctgggtaaagaccgatacatcatagtactggtcgattgggctatattcgatatgttttactatcagacgcgctttttcttcgttaatcagttctgaagccttaataataaaatcttcgggattatttttgaattgggcgaatacattcggctttatccgggcgagaatctgagcaatagcctttcgagtcagatttgtaccttctgtgagtttaccgagcaggtcatattttacttgatcgtttgctgcggcatctatcttttcatagtgtgtctgaacatttattttgaatgcttctcccgaaaccaaagctgctttagacttgatttcatccatttggcctgtagtgacagaaagatagagttggggaactcttaacttttcattcaatgtctcaatcgctttctccaccaattctttttcgtcaaactttacggtgtaggttgacttgctgcatagcagctttagcaattcctgaagtttgctgttttcaagtttatctttcgacaaccgaagatttatgttatatttccttgcatcgtccggttgcatctcccttggattgtagatagaggccaggatgctcatgatagatgccttataatctgtgagctcgtcgtcgaaaatcacttctccctgtttacggtcatcatagaatttatccgtcagttctcctttcttgatgtacttgttttcaagtaaagagtcgtagatactttgtgctatatcttcggtggctatgatggtttcaccgttaggcaatcggagcgtcttgcccttgaataattggatagttactttctgtgggcggtcggctatggcttctgccatttctgtctgtaagcctttggcaaacgattcatacgattcactggctatcacggtcagtaggttgacacgatgcatttcttcgcctaaaacgttgacgtccatgcgttcgccttgtccgtttacacagaggcgcagcccgcgtcccacctcctgacgcttgcgtacctctgccgaactttgttttaaggtacagatctgaaagacgttcgggttgtcccatccttcccgcagagcggaatgtgaaaaaataaagcggatcggctcttttcggtcaagcagacgttctttatttttcataatcaaatcgtaagcctcctcatctgccgattctttggttctgcgctcggttttactgttaatcagttttccttttctatctttagagaagtacccttcgtgagctttcgatgccacggtcgatttcaggtaatcgatatattccggctgattgaataacgaaaaatccaggtgctttatgatatcggtatattcctgttcgaaaatctcggcatattctccttttccgtccgggttataccggcggtatttggctacttcatcgatgaagaaaagggagagaactttgatgtctttctcaaacagttcctgttctttttctatgtgtgacaagatagtttcgcgtatttggatgcgtcgtagttgagtttcgttgacgctacccgctacgtcacctgcataaagtttgataccgttccggaaggtgacggaattttcaacgccgttgatatctgtaactacatagtcgttccggtattcctccagacggtttgatttagcgtacaagtcatcatttactttcagagtccgtactacctgatttactgctttggtcctttttatttcgaatccgatattggcagtcggatttttgtccggatacaggtttaaaccttccagatagacgaagccttcggtggctgttgttccactgatggaaatacctttgacagcaatcttcttaaccagtttcaggttgtaagcttccatcgcgtccaggcgatagaccaggttatagagttcgcggtgtgtagccgaataacgcagtgtgaacaggggattgaatcgtttcaatccctcttttgttttgactccttctaccgactggggttcatcgataatcagtatcggattcatttgtgcaatcacatcgataggacagctgccgccaaaatcatccagtttcatgtagatgcggcgggcgtctttgttcgtagcattgaacttctgtgaattgatgatcattacatggattctgctgtctgtgacaaatgcgttcaattcacccaactgtttggagtcgtagatgaaataagacagaggggtgctgtaatccgaggcaaagtgttccttcataatctccaggcttttgtggactccttcgcggatggcaacactgggtacgacaatgatgaacttgcaccaaccgtagcgtttgttcagttcgaagatggttttgatgtaggtatatgttttgccgactcctgtctccatctcgatggtgagattgtatttcccttccagcgcttccgacggtttgatttgttgggcacgctggatatcctggatatgtttcagaacgatctcatctgtgagttggggtacgacagggtggttacggaatcctgtaaacctttcgtaactggtctgtccgtctttcttccgggtctctacttgatagtcgagcatcttgtatggctgcccggcaaagacatcacataccgcttttgctgcgtcttcctgaaacttttgatgtttgaattttaatttcatttctgtatcttccttctctgtttaaagaatctcgatcgtagtaccgggagataacgttttaaatatctcgtctatgttgatgcgatcggcactatctctgaacgaggcatcccggaaaacaacccggcgtggttgcctaccggctatttcacggaagacttcttcgggaatctgttctgcgaaacatgccattaattcggtcttgtcgacagaataaaccgtatatccatttatatcctcttcatcgtgtgggagtgacagggatagtcccaggttggtcaggcaaccataaagcagatcgagtccggtacggtcttctttgatattgtctgtgaaataaaacaaatcactttgtgaatattcccctgcactgtaatatacgtctttcatattgctgtcggcaatccgaaaaacacggaaaccgatgtccgggcggttctttaatttaagttggttgcattccgcctcaattgtgtctccggcacgtcgaatacgctctttggacagttcgcagatgttcaatgctttatgcttttccgtgaggaagtcgatcgcgttttgcatgatctctttttcactgggagtcttggccttttttattgtttcagtcacatcttccggcagttgtacgagaatgtacttcaccttgtttttacgcggtttcatgttcatccgcataaccgcttcggcagtagtgccactaccagagaagaagtccatcacaatacaatcttggtttttggtgtcgataaactcacataaatattgaatcagactgacaggtttcggaaagttgaacactttcttatcaaagaactgtagctgatagttaccggcctgctcattagtttcaactcctactttgtaattgatcaggttgggtggaacttccgggtcatattccagtttttcgtacgaaggacttaacttaagagtcggtattttgatggttgttcctttttttatctctttctccagattttcctgactccatttgaatttggctttcagcttgacgggggctgtaaacagtccgtcacgtacggtggtatcttccagtaattccacgtcataagcatttgttccgtacatgcccgcttttatcactccgtcggggatggaagtaactactttgttggcggggaaagtcagaatgccgacggaattcggttgattcaacagaccgtttgaactgaccgactccttcttcagaccctggaatttcatgtcgtttttcttcttctgatagcagacaatgtattcgatgatttgcttgctttttttcgagagattttccggagtttccgtctttgcccaattaaaaacatcgatgaaatttgaagcattgaatacttcatttcctattttaatcaggtttgccagttcgtgatcgtcaatagaaatgaaaatgatgccattatcatttaataggatacgggcaagcatcagccgagcatacatcatgctgcaccaatcggaatgaaactttccgttagcctctgtattcagaaacaaccgttgcccttcctcattatatctgccctgtttctcgtcggattcttcctgtgaaagagcgaatgtgtcattgaagataaagtctttacctgtgttgtaaggcggatcgatatagataacgtctacctttcctgcataactctttttcaggagtttcattgcgtccagattgtctccctcgatgtacaggttttgggtttgctcccaattcctgctctcttccgggcagggacgtaatgttttgcggatgggatgcgccacctctcttatcgcctgcttcttgcctacccatgttaattcgtaacgttcgtcgtcatcatataccactcccatttctgcttggttggctgtaaggaggaatttcagtttatcaaagtcgatagctttatgtagttgtccgtccttacccatcgattcagtgactacgttcgggaagagttcggctattttattcaggctgtcctctgcgatactcacagattccatttttagcttttccatatatgatttcatttttgtcctgcaaagttaagattttcattctgattggctaatttcctctataaataatgtgtgttttgggaagtaacgtaccgctattccgaaccggttgttggattaggtaataaggtaagtgttttatcttgctgaccggatagtcttatgttctaatcatcaatcgaaaaacaccctcatgtttttcgattgatgattaggaggaaacgggcataggatgtgaaggtgtttcttgaattataggaagcaagtgtatttacttgtatttattttcatagaatatgccttttctgaatacttttgcctatttttgcgtattcaatctattgacagaatggagtaatatttagttgaaattttatagtaaaaatcatgaagaacgcaattggtaattgtaagcagcgaaaagcagtgctcttcgctctcgctttgcctctgatgttttccggttcgcctatgcaggctatgcatcggtccgaaatcgttagagaggtgacacaacaaaacttgaagatcgttagtgcaaagaaaatcaatccgactacgattgaagtactgttctctaataaccagagaatgacattcgatttctacggagagaacattttcagagtatttcaggacaatgatggagaaatcatccgtgatccggaagcgaaacctgaagcacaaattctggtaaataatcccagaaacacagtctctacgctcgacttaaatgatggcggcaatctcctttctatcactacggggaaaatcaaggtggaaatcgataagaatacttctttgatgaaagtgatcgacctggaaaagaaagccgtagcttttgaagaagccgaaccggtactttttgataaaggaaaagttactgtaactctgaaagagaaccccaacgaatatttctatggcggcggtgtgcagaacggacgtttttcgcacaaaggaaaagcaattaatattgtaaacgaaaatagctggacagacggtggagtagcttcacccacacctttctattggtctactaacggctatggcatgatgtggtatactttcaaaccgggtaaatatgatttcggtgcggaagaaaaaggtaaagtgaagcttacgcacgattctccttaccttgatgtattctatatggttagtgatggtgccgtaggggttctgaatgacttttatcaattgaccggtaatccggtgttgttgcctaagttcggtttttatcagggtcacttgaatgcttataaccgtgactactggaaggaagacgaaaaaggaatcttgttcgaagacggaaaacgctataaggaaagccagaaagataatggtggaatcaaggaatcattgaacggagaaaagaataattatcagttctcggctcgtgcagtgattgatcgctataagaatcatgacatgcctttaggctggttgctgccaaacgacggatatggtgccggatacggacagaccgaaactcttgacggaaacatccagaatctgaaaagtctgggcgactatgctcgtaagaatggtgtcgaaatcggtttgtggacacagtctgacttgcatccgaaagaaggtgtgagtgcgttgctgcaaagagatattgtgaaggaagtgagagatgccggtgtgcgtgtattgaaaacagacgttgcatgggtaggctggggatattccttcggactgaatggtgtggcagacgtaggtcatattatgccttattacggagatgatgcccgtccgttcattatttcactcgatggttgggccggtacacaacgatatgccggaatctggtcgggcgaccagacaggcggtgtatgggagtacatccgtttccacatcccgacttatatcggttcaggtctgtcaggtcagcctaacatctcttcggatatggatggtatcttcggcggcaagaatatgattgtcaacaccagagacttccagtggaaaactttcactccgatgcagctgaatatggatggatggggatcgaacgaaaaatatccgcatgctttgggcgaacctgccacttctatcaaccgttggtatctgaaactgaaatcggaattgatgccttatacttatagttttgcgaaagaagctgtaaccggaatgccgcttattcgtgctatgttcctggaatatccgaatgcttatactctgggtacagccacgcagtatcagtttatgtatggtaccgacttcctagtagcacctatctataaagccacaaaagcagatgctgaagggaatgatatccgtgacggtatttatctgcctgaaggagaatggatcgattatttcaccggagaaaaatatcagggtaactgtgtactcaacaactttgctgctcctctctggaaacttccggtatttgtgaagaacggagctattatcccgatgaccaatcctaacaataacgttgctgaaatcaacaaaggacttcgtatctacgagatctatccgtataagcacatgatgactgttgaatatgatgatgacggtgtatcggaagcatataaggatggtaaaggttccacaactttcattgagtcaaatgttgattcgaaaaacaatgtgaagatttctattcgtcctacacagggtgatttcgacggttttgtaaaagagaaagctactgagtttagggtaaacgttactgccaaaccgaagaaagtttctgctcaagtgggcaaaagcaaagtgaagttgatcgaagtggcctctatggatgatttccagaaaggtgagaatgtatacttctatgatgctgctcctaatctgaataaatttgctacgaaaggcagtgaatttgaaaagaaggtaatcactaagaatcctcagcttcttgtgaagttggctgctactgacattactaaaaatcaggttgtgatgaatatcgaaggcttccagtatgcgcctgccgataattacagagtaacgtccggttcgctgactgctcctgcagctctgattactgccgagaatattgaagcttatactttgaaacctacatggagcaaagtgccgaatgccgatttctatgaaatagagttcaatggcatgttgtatacaacaattaaggatactgagttgctgtttgacgggctggctgctgaaaccgactacgcattcaagatccgtgccgtaaacaaggatggctattcggattgggctgaattcagcgctaagacaaaagcgaacccgctggaatttgctcttcatggaatcaagggtgaaacaactgcgaagaatcaggaaggatttgatatcgatcgtttgttcgactttgccgaattgggtgatatgtggcatacgaagtatggagcaaaagcgctgccatatgacatgattatcgacttgagaactgtgaaccagttggataaattcgaatacctgccacgtaccgacggtggtaacggaacgattctgaaaggtactgtatattacagtatggataaagagaattggactgaggccggagcaatcgactggaaacgtaatggtgatgtgaaagtatttacatttactgagcgcccgactgcacgctatatcaaactggctgtaacggaaggtgtgaacaattatggttcgggtagggaattgtatgtatttaaagttcctggaacagagagccgtttgcagggtgatatcaataacgacggtaagatcgataataacgatttaacttcgtataccaactataccggtctgagaaaaggtgattccgactatgaaggctatatcagcgtaggtgatatcgaccagaatggtttgatcgatgcttatgacatttctgttgtggcaacacaattggaagatggtgtcagcgatgaaccgattgagaaactggatggtactattgagatcagtacggctaaacgaaattacagtaagggtgatgtggttgaagtgcttgtaaaaggtgtcaacctccgttctgtaaatgccttgagttttgcgttgccatacaatcagcaagattatgaatttgtaggtgtcgaacctttgaaccttaaagcaatggaaaatctgacttacgacagactccataccaatggtacaaaagcactctatcctacattcgttaaccttggagctaaagaagcccttgaaggaacaaacgatctgtttattctgaagctgaaagcgaaacgtgccgtgaagtttgatctgaaagctattgatggcgttttggtcgacaagaacctgaacacacgtaagttttaaacttgtgtaagaatactccgccgtttgaacggagaaaaataaaaagctgcccggaaatttccgagggcactgaaaaaacagatggcttttcagtgccctcttgaagagcaaaagtgagagtcgccaagttagaaatactaacttggcgatttttctatttggttccagtaagtaaaatgcttcacataacggttgacatcgtacttacgaacgtagttgttaaaccgagttctgttcaaaaaagtggaaaagttgagaaaaagtgtatttatcttgattcatcattacagctgcaaaaatagaaattcaaatccgttttatttcaaaatataacttaatcgactatatttcaatcatttcaaggaactattatttactttaacggaacagtagtgaaacatttattatataaatacaaaatattatcataattcatagtaataattatattaataatagtagctttgttactccttaaacatatagttaaacaatgaaactaaaacacaaattaaactatatactacaatgaaaaacatgaaaattgcatcctttatgataaaattcataatgatgcccctgcttgtcagcacttcctgtgtaaatgaaatttcagaagaaccgacaacccttcccggagaaattcctatccgcctttctacacaaattttatgcaaccccacacgtgttattgataacaaatttcaagaaaaggacgccattggcttgtatgtattgacacaaccatcaactatcaatcagaaacgatacattgacaatatgcgtttcacatgttcccaaacctccggcttcgaaccggaagaaacgatttattatcctaaaggaaacggagaatgtaacttcatcagttattatccttttcaagaaacaggtattgaaccggacaaaagtacaatgcaggtccagatacagaccgaccaaagtactgtgggcggactatcactttccgactttatgatcgctgtaaacaatgacattacacccagccagaacatggttgccatggaatataaacacaaactttgcaaactggaaatcattataagacccgcagccggagaagacttacaagagctcttggctgataaccctaccttatccttaaacggattccattcggaagcatcttatgattttctcaccggccaattcgggtcatcgggacaaacgagcggcattattccttatggagaatggaaaatagagaataatacccttataggcaaaaaagcgatactgatacccgaaaaaatagagtctgacagtcactacataaatatggaaatagatggaaagagctatagttgcccatttccggacaactttcagctgtccagtgaaaaaagctgttccataggcattatctataaatcatccgaaggtattcaaatcaacaacttcgatcatagcattgcagactggacagaaggggagtcgggtgaaacgacagctcaggaaacatcaggtataattcacctggctgcactgaaattcagtaagagtaatgtgtataaagccattaacgaagggacgcaggtagcagagatctgtaaagagtatctattggcagacaatatcgatgcacaagccatcgtcgcctatcctgttctaaatggagaaacagatttaaacaacggcacggtaatttgtttacttgacgaaacagcagccgttcacggaggcaaggtctcttggaacaaaattaataatgtattagcctacacgcccggaaatcaaagcgtcatcaacgatttctacatagccgaagataactcaatatcaatatccaagccggaaaatcctctacctgtacgattgcaagaagatgtcttgacagatatacggaatacggaaaccaaaacttatcctatagtaaaaataggaatccaatattggatgggacgtagtttggaagcgacacgctataccgacggtaaaacaattactttgaaaaaggatttcacggcaacagcaggctattacaccgggaaatatcaagatgcgcctcaaaatttttacttttacaattctgaagctgttatttcaggcaagttatcaccccaaggatggaatattcctaccgaaaccgagtgggaacaactaaagcaatatataaacaatgatgcttctaaactgaaatctgggccatggtcaagcgatgaaagcggtgacaagcttcctatacttaacactacaggattcaatggaatgccggaaggatatattctaaaaagtaagaacggatataccaacggcttatatacggtggtatactggtctaccaattcatctggaaatcaaataaataaagcaatctatttgctgcatactacaaatgaaataaaagacggcaatataacagacagagctctttctgtcagatgcatccgtaaataacaagcactttgcctatcatacagaatctaaagtttaggtagatctcctcaccgctactggcccaaactttagattctgtattttatcgttaaattattctcttcattcgaatagggaatcttcttcttttttctgtctttataatcaagaaatcaattataaaacccaaaacagaaaacatatgcagaaagtattatttatcactacaattctacttacattattcgccctctctatccatgctgagcacaatcctcaaaaaagaccagatgcatctgcccaattccaaaccgtctccggtcacagtatcagtttaaatggtatcggactggcatatagttatgaatatgcttttgctccgaaaggtactgttatttttagcgcaggagcttcttatgcttttgaaagaacatggcaactcaaaatggaatcacttcgcgaattccatatcgctaccaaagactatcatttagtaaccggagatttagccatagaaccacgtttttattataacctgaagaaaaggcatcgcaatggcaagcgtacttggggtaattccggtgggtatttatctgcctgtttcggatattcttttccaatagccatcagcagcggagtaaaaacagcgcatatatatgttatcaccccatattggggatttcgacgcgtatggaaacattttcttttcgatctatctggcggagccggttatataaagtcctccaacggcaattccgccatctatcctactgtgagaataggactgggatatagattttaaacgtcatactctaattgaagaataaataaccaaagtaccgaatacaaaaaatggctactcatcccgagcaaccaatcttttgttaaccttaaatctaatacttatgaaaaaaacacaatacaaatataccgaatttcaagcaattagcaaatatcagagcaaaaatatcctgtattataacaccgtttaatactcgatcttgttttgttaatactttaggctaaaaacgttaacaattaacacattcgttcacagttctcctgtagctctatagccataggaaaaacaatattattttctaaatgaatatgatgatgcaaatttttctcaaatgtctccaacatctcaaataataacctgtaggtgtcacaagcatcatcgggtactaaatatccctgagccaataaagaaatccggcgaaaacgttcaccttcggcatcatgttcatgcatcattaccgaaatagggctactgacactgccacaatgaaaaggcggaacggggcggtgttgggtcactgcatcgaacaaatcgtatatataaggaaacaacaccatttcctccttggtaagatgattattcagatctatccaggactcctgaaacaacccacgtatctcatgaagttccggatgcttctcaccgtgtacctcacaaactttatcaagcaattgaagaatctgcggtccctggtaacggatattacgatgatggaatttcaggatgtaatctaccaataaatccataggccaacttttaaaatcaaaaatcggagaatggttcggttgcgtttgccccaactcttccaacaagctgtccacccctgctccggctctttcacaagcatcagtcagcgagacatctccattgcaacagaaatcaatgccatacttattgaatacctttgcgtggtcaaaacgatcggctacaatctggccgactgtcataagtttataatctttcatattttcctcttttattattcagaggacaaaggtcgggaacagaaaacaaataatttgtaaccaatgttacaggaaggattttcttttgtctttcgaagcaatatgaagtataaaacaatggcatacacagtcttctataacttgtgtatgccatattcttttcttaattaaaataatacagaaagatagcgataccttcgagtgctttcttaggctgatctttaatctcaatcgcaaacttaatttcagctttagccacaccacgcaagttagtaagagaatgcagacttgccttcagtcgcacactttgacctgacagtactgcttgcccgaacttcatcttgtccataccataattaatcatcatcttcaaattatttacttcaataatctggttccacaaatgaggaagtaatgacaatgtcagatatccgtgaacaatggtgctatgataagggctctccaccttagcacgctctgtgtccacatgaatccactgatgatctaatgttgcatcagcgaaaaggttgatacgttcctgagaaacctccagatagtcagagactccaatctgctgccccactaatttctcaaaatcttcataagaattaataattactttatccatatttcttcatttaaaaatgtacatctttgctacaaagatatattttttttagataagttaaaattaatccggtcttttagattcttcattagaaaaactcgccggcttagtacatgaatctactttcccaaatatccgataccgatatttggaaaccaataaatacaatgcatcccttacttttaccggaatcaggatcaatggataaaaacactgccagaatcctcccaggtcttttaagatataaagtatagccgtagatttagaataacaatctcctttccggaaataatagagagtcttattactactttcaacagcataccgatccaacaaagttttacccgcttcagattgcagtgaaacaaaacggaacagctttcttttatccctctttacaataaaagaaactgtcccgttgcagagattacatataccatcgaaaagtataatattcattctatatttctaaataatggaagtctcgtatgcactggtcaacatatcataatcggcatcactgtattctcctttttcccgagccttctgcacctgtttgataaatgtttctacctgtgaaaggaaagtctgataagacttcatctcgctttcatgaccattcacggcaggaagttttttagcagcatcgagttgtttggtaagttcagctactttcaggtcaatgcgggggccatccatcatatgcttacgtgcatacaggttcaaaatactctgcatcgtagcagacatcttccgtacagacataatctgttctttcagcggactgtccgccagaagcacctgttcagcctgttcggtaaacggactcagaatatcaaaaacattctgcttgtattcagacatctgtgtgctcaactgataattcgcctctaacagttgcttcgctttggttacatctttctttttcaagtaagaaagataggtatcgaaatttgcgtagaactctgctctcgccttaaacaatccggcatagttctgcaccagattctggcgggtttctctattgaagtaatctccgggattcatcaccgttgccgaatcttttgcaacaactgccggtggggcgatggcggtaagagccggtacttttcctttttgttccatataatccaaaacggcatttacatctttttccttcaccatatcttttaatactccgagagaagtattataatatttgattacctctgtcgcattttcaatatctgccgtactggcaacaggagctttgctcttgcttccacccgaacaagaggccaacagaaaagcactcacaagtgctccaaaaaacaatagattctttttcataatgtttcctttaataattagtaaatagaacaagcctatagatagctgatattgcactaataacaatataaaagtcgttttgctctcaaaaccatctataaattacaaagggaacaaagaaattaaagaaataaatatcatcggaagcgaaaccacattactgcataaaacaaaaaatggctactcgtcccgagcaaccaatcttttgttaaccttaaatctaatacttatgaaaaaacacaatacaaaaataccgattcccaactaattagcaaatttacgcgcgatattctgctctattataacatggtttaatgttaccgataacttcttaacattttacacttgtactgttaacaattaacaagttccattactcgttttcagacataaaaaggctatcatacctcatccacccaataacgatgatatccccaccggtacaatattactgaatttctttatcccccctgatcatattccaatccttcagataacaatttttccgatgacaatgaacatattacaggtataaccggtatttcattcataacgaaatgaatgtagacctcaaaagatagtttataaccaatccacacaaccctatgcatttctgaagcagaaagatagaaatcagacaaaggcagtaatctattattcaattctaacagttcgaatgatggaaaaaagagaagtcgatattgtgatattctttcaataatagaatcttgtcactttatttattctttttgatttcttgtatattaatgtttttttcttgcttaagacatcagatagtggtatatttaccccgaaacacttcagcccgtttcttaaccttaaaaggaattgaatatgaaaaatttaaaataattattgatcgtactaatctttgttacataaaaaaacaaataaaacaaataaaacaagtaaaacaaataagatgaaacaagtaaacactgttttgacagtcattctgttggtagtattgacaggatgtggaagaaataaacaatcaaacgatgatttaatcatcgtagacgtttcgaaaagctatcctaaaaaagaattgattcttcaggattttatgaatgtggaatatgttgcgctggaaactacagatgagtttcttacacaaggcttagtacaagatgtgggaaaagaatacttattggtaaccaataggaataatgatggggatatttttatttttgacaggcaaaccggtaaaggattaaaaaagataaatcggcgagggcaaggggcagaagaatatgcaaggattaatgagattattcttgatgaaagcaatgatgaaatattcgtaaagtcaccgggaaataaaatcttagtatacgatcttaacggagaattcaaacggtgtttgaatcttggtagagatgtttcatctatttttgattatgacaaacataatttgatctgttatgatatgtcagattatcataacaaaggaaaagatagaaacaaatcgtaccatattcttatatcaaaacaggatggaagtatcacccgggaaatttttattccttttaaaacgattaacacaccgattgtgactgatggagatcgatttatagcaaattattcttaccaaatacgcctaagtaacggcaaatggacacttatggacgcatcagccgatacattgtataactatgcaccggatggtgcattaaacccctttattgtaagaaccccctctgcaaatactatggagcctgaaatttttctttatatgggtattcataccgaccgttattactttatggaaaccgttaaaaatgtatttaactttgagaaaggtaacggattctatacagatgagctggtgtacgacaagaaggaaaaagccatatttcaagttgccgtatataatgatgactatgcagaaaaaagaactgtagctatgacggcgaaatcaattaatcgcgatatcgaagatgtcacgagtttaagtgcatcccaacttattgagatttataagaaagagcaactgaaagatggcaaattgaaagaaattgcttcaaagttgaatgaagaagacaatcctgtaatcatgttggtaaagcaaaaaaatagtggtttaaaatgaaaaaggcaaccaactattttatcaagagcagtggatcatccagcacctgctgaacactccttttattccattcgcaggattgttgaccgaatagagggtgttgctcttgttctttacgtatactatgaggttgtgtcaaaacgtttttgacacaacctccttttcacatttacattcaatcattataaaaataactaacctttcatcatgctatgcttatcatgattttatttagccttttacggtaattcgtttgtaaccatatacagcacggtcacccaattcttcttctatacggagcaactgattgtacttcgccatgcggtccgaacggctcaacgaaccggttttaatctgtccgctgtttgttgctacggcaatatctgcaatggttgcatcttctgtttcgccggaacggtgagaggtgactgttgtatatccgtggcggtgtgccatttcaatagcgtttaatgtttctgtcagcgaacctatttggtttactttaatcagaatagaattggcacaacctttttcgataccttttgccaggaaatcaacattagtaacgaaaaggtcatcacctaccaattggcagcggtcgccgatacgttgagttaattttttccaaccttcccagtcattttcactcataccgtcttcgatagaatcaatcggatattcgttgataagtttctccagataatcaatctgttcctcggctgtacgttttttacccttttcaccttcaaacttggcgtaatcgtagataccgtcatgataaaattcggaagaagcgcagtccatgccgatcattacatccttacctggttcatatccggcaactttaatagcggcaaggatagagtttagtgcatcttctgtgccttccagattcggagcgaagcctccttcatcacctacagctgtactcaaaccacggtcttttaatacttttttcaaggcgtggaatacttcggcacccatgcgcagtccctctttgaaagagtttgcaccaaccgggcgaatcataaattcttgaaaggcaattggggcatcgctatgtgatcctccattaatgatattcatcattgggacgggcaaaacataagtatttgtgccgccgatatatctgtaaaggggaatatcaagataattggcagctgctttggctacggcaagtgaaacacccaggatagcgtttgcacccagtttggcttttgtctttgttccgtccagtgccagcatagcatggtcaatgcccatttggtcaagggctgacataccaatcagatgtggggcaatgactttattaacgttctctactgctttctgtacacccttaccgccgtaacgatgtttatcaccgtcgcggagttcaagcgcttcatgctcaccggtcgatgcgcccgacggaacggatgcacgtcccatgatgcctgattccaatactacgtctacttctactgtagggttacctcttgagtcgagaatctctcgtcctgtaattttttctattttcattatttctcttgttttttagtctctgcaaatgtactcacttatgggaagcggtagaataactattaataggtattccgtgcggtctctttccctataaatcagtattatcgcttttatactataaaacaaagagaggggtggaaaagttcagtcgtcttcaaccttgactcctaacagaggcagtaagtccattgcctgtaatgaactgactatagcccctttcaggtcagctatgtttagttgaatacctgttattcttgagctcctgaggtcgataccttttaaagacgtatgcgaaaaatctgcttcaagcagttcacagttgtcgaaagctgccggtattaatttactgtcattgaggctggcgtttcgaaaatcacaatggctgaaacgaacggttcgcattttcgtcatggaaagattgatatattgtccataacaatgctccatccggacatggtttagggtggcttctggaaaacctgttcctaagagcttgcatgatataaattctacccggtagaaagtagttccggccaaaggacacgttggataagtcgcaattttcaaaacgtatgtctgttaattgggctgatttcaactggcattcgttgaatatttgttgtttgaaagtacaattgttaatacttagatagggcttatttacttgtcggacaactcctttagagaaatataaatcagaaattttctcttcatccaccaaaatatcgagcggagtgatgctttcggactgctcattgatgaatggggctatgactttaacaggttggactttcttaattgctggtttcatatattagtctattgttttaaatgttctccgaggtatcctccacctaatacggctaaaagcccgagtatcatactggttaatgtgtaaaatgcgaatatgccgtagaagcctcctttcagtaaactcaggccatcattagccaaagtagaaaatgtggtaaaacctccacagaaaccaacagtcagaaatagccttaactcgaaggatagatcaagacgttccgaaagtgaataaaataatcctattaacagactcccagcaatgttcacggcaaatgttccccacggaaaggggaaaaaagtagggctaagtttttcgttgacggctatttgtgccagatagcgggatacactgcctatgcctcctccgataaatatgtaaataatctctttcatcttttttgttttgttggcaaagttaccactgtcaactgtttatgcaaacgttttctgataaatcttctttatttcggttccattcgtcgaaccggaatctgcttcttgcttatctttgttgcatgattactaatttatattaaaccatatcatgaagaacatgaataaactgacttttaagttggcttgcttttttctttctcttttagtgagtagtgtggcaatggccgaaagcattacttctccaaatggactcttgaaactgaacttttcggtgaatggaaaaggcgagcctgtgtatgaactttcttataagggtaaagaagtgattaaaccttctaaactgggccttgaactgaaagatgatcccggtctgatggatggttttacattgattgatgccaagacttcttcttttgacgaaacctgggaacctgtttggggagaagtaaagcaaatccgtaacaattataatgagcttgcggtaactttagaccaaaaagctcaggatcgtaagatgttgattcgttttcgtttgtacgatgacggactcggttttcgctatgaatttccgcagcaaaagaatctgaattattttgtgataaaagaggagcattctcaatttgctatgacaggcgatcatactgctttctggataccgggcgattatgatacacaagaatatgattatactcgatcgaagctttcggaaatacgtggcctgatgaaaacagctgtgactcccaatgcttcccagactcctttttctcctaccggggttcagactgctttacaaatgaagaccgatgatggattgtatatcaaccttcatgaagctgccttggtggattactcttgtatgcatcttaatttagatgataaaaactttgtttttgaatcatggctgactcctgatgcacagggagataaaggatatatgcagactccttgtcagtctccatggcgtacaatcatggtcagtgatgatgcacgtgacattcttacttccaaattaacattaaacctgaacgagccatgtaaattggaggatacttcctggattaagcctgtcaaatatgtaggtgtatggtgggagatgattacgggtaaaagtacatgggcttatactgacgacgtttattcagtgaagttgggtgagaccgattatgctaagactaagcccaatggacgtcatggtgccaataatgagaatgtgaaacgttatatcgattttgccgctgaacacggttttgaccaggtattggttgagggctggaatgaaggatgggaggactggtttggcaagtcaaaagattatgtgtttgatttcgtcacttcatatcccgactttgatgtgaaaatgttgaatgaatatgccaagaataaaggggtaaagttgatgatgcaccatgaaacctctgcatctgttcgtaactatgaacgccatatggacaaagcttaccaatttatggaagataacggctacaacgctgtgaagagcggatatgtaggcaatataatcccacgcggtgagcatcattacgggcaatggctgaataatcattatctctatgcagtgaagaaagcagccgatcataaaatcatggtaaatgctcacgaagccgttcgtccaaccggattgtgtcgtacgtatccgaatctgatcggtaacgagtctgcccgtggaacagaatatgaagcttttggtgggaataaaccattccacactacattgcttccttttacacgcttgattggtggtccaatggattatactccaggtatttttgacactcaattgtctttcttgagtggtgaacatagttttgtgcatactactttggcaaaacaattggccctttatgttacactttatagtccgctgcaaatggctgccgaccttccggagagttatgagcgccacatggatgcatttcagtttattaaagacgtggcagtagactgggatgacagtaaatatattgaagcagaaccgggagaatatatcacggtggctcgaaaggccaaagggaccgataattggtttgttggaggtattacaggtgaaaatccccgtacttctacattcattcttgatttcctggatccggggaaacagtatgtagccactttatatgctgatgggaaagatgcggattatgagaagaatccgacctcttatgagattaaaaaaggtatagtgactaataaaaccaagatctctactaaattggctcgtagtggaggtttcgctctcagtctgatagaagctactccggccgaccgaaaagaacttaaaaagtggaaataaaggtggggtagtggtaaaaaggttagtttggttatttttttgaaatgaaagagtccggatacacaatatgtatgtccggactccttttgttgatagttactatattatcaattaagtgagtcatctcttgactttctatttttatctgctgttttatctttattgattatatcgtttttaatcaagtgattaatagtctaatgttgaatgtttataaagctaactttaacatagagttaaagcttgttttttgaatgcaaagaacaagttgtttgcatttaaaagatttgttctttgtacagagggaataacgatctttgttttctccttaacattgttaaattattctgttgtgattatatctttgctttgatagcttttgttccctatatataataaggtgtaaacaactctacttattagctcctccatccagtaactcggctattttctttttcaggtttagcttgataatttcatcttgctgcagttctatttctactgtaattttggcatttcccaatttatatctgatagcttcgttatcacaatttatctgttcttgtttgatgctatataaaagggcaaaatcataatctaacgccagtgaaatattatataatgtatccgtatcaatgcttttccttgtcagtagataatctacactttgaggcttaacgtccaatcttcttgcgagttcagctttagtgacctgcctctcggacattatattcttgataatttcacctatataaatattgctttttttcatttgcatgaaagtacaacataatccgaagagttaggtttatcggcataaaagaatatctgtctatttctgtattttgttcataatttatttgttttatcagataaattaggatatatttgctgcggataacagagaggagtgcactaacacccttctggtaacagaagaaaaaacagagtggaacataacatttatattattattattaacactaaaattttgagattatgaaaaagaaactcatgatggttgcagtgctcctgggtgctttgtcactgggagcttgcgtagacaacgacgaatcggcatcggtaacagcggtgcgtaacgcaaaagcagaacagctgaaaggtgctgctgcattggctaatgcacaggctggcgttcaggatgcccaaaaacggttgactgaggcaaaagctgcggctaaagaatttgaaaatcaaaaagatcaagaagcctatgaacgtgacaaagagaggttgatagcttaggcaaatgctgatttatgggcagctaaggctcatgaagaaagagcaaaacaagacttcctgaatgttgcggatgaacaattgaaggggttatacggtgagtatcaaggttactcttctcagttgagtagtctacaggaaacaagagatcaaaatgcagttactctggctaattataaagccgggcttatatcttataaggaagtagttgaaaagcagaaagctatcaaactggctaatatagctcagaatgatgctaaaattgctgcttatagtaagtacgatggtttggataaagctgatctacaaaataaagcacttgaggcactgcagattaaaaataacgcaataaaagcaacaacagctgccgctcaagctaaagttcctgcacagaaggcatatcaggatgctattgcggactttacaagtgatgaatcttctttgaagactgtggttgctgctcgtaccataatagatcaattgcagaattttggtgttgccactcctatcacaggctgtgaatatgattatatagatggtactggtgtatattactattcaggtctgttgtacattggtaatggagaatatattcagccaatcgaaataagttcaaaagagatagcagaagatttatctgttacttattatagttggaagtctgaatatgctaaagaaaaggcaactcaaaatttcaataataaatatgctgctgctgttaaacttctgggcaaatcaggtgataaggctgacgcaggaaccaagtatgctgatttaaccgcagcgaatgaagaactgaaagctgccggtgaggatcaagtaaaaattgatgctgccaacattagtattgctaaagctaaggatgctataaatgaacagaatgaatccattgctgaattgaaagagacaatagagttgattgcttcaatgtcgggagcagatgttgctgcttatgataaagctattgaggctttgaagacaaatgaaacagttttggcttatgtagctgcgtgcgatgcgtatgacgaggcggacgaagcttacgaggtagctgatgcgaattattctgctttatctgctttagcaaataattatggggtagatgccaaggccgaaattcggactttagaagctgccaatgcaactttaaataaagcaattgcagacttagattctacttatggcgttttgaatagtgaacaacaaattgcacgtcttgaggtttctgtagctaatcttacaacgcagatcgatgctattcagaaacttatggatatagttatggagcagattaatgctttaatagcaaaataatcgccaatagtaacggcaaataaacaacaaatcaaaaaaagtatcgtatgaagtgtgagcttaagaagatcactattcctctaaaagtagtttttgcacagactcccgactacatccagcgtctcagggtagagaaggcagcatggaaattacagaaagatcccttcccgtccatcaccgagattgcttacagctgcggtttcggcagtacatccctgttctgccggaccttcaaaaagtatttcggcatcacccctacccagttcagccgaacggataagccggtctatgtattcgaaggaaacctatttagcaagaacgggcaagcgatccgcaagaatatgacacacagtgcagtggcaaatttcgacctttgcggtgtaaaactaaaacaactatattttatggaatcaattgtagaagtaaaagaaatgccggaaatgaaggcgatctattgccgccacatcggcccgttccacctgattggccaggcttacgcaaaattgggacaatgggcagcacccaggggattgtacacgcctaatgttactaaaaccgctaccgtcacacacgacgatccttcgatcaccgatgaagacaaaatcaggcaaagtgcctgcatcattgtcgacaaagaggtgaaggtagaaggcgaaatcggtaaaatgacgattccgggcggtcagtatgcagtcgggcatttcgaacttggaatggacgagtttcagaaggcatggaacaccatgtgccattggttcaccgaaagcggctaccagcaaggagatggatgtgcgtatgaattgtaccacaacgactacaccacccatccgcaaaagaaacacattgttgacatctgcataccggtaaaaccattatagatcaaaagaaaggtatggaagactaccttaaagtagaatttaagagtttagtatcttattagattgaaaccactttaaggataattcccttgtttaaatatgaatatattaagtaccaatacatatttagttatcaatatcaatttgagtataatattaaagaccaataaattatacttctaatagattcagctaatcctgattaactacttaataatattagatgaaagcaagggaattagcatgtttcgacttacagcgttataagtaacgctgccttattttcctattatattctcttttttttaaaagaatcgtatctttgtgcatctataaaccttttaatcctttcgcccatgatagaagctcccgaagctcgcctgctgtgcgagcaactgaacaaaaccgtatgcggcaaacgaatcacggatgtattcgcccaatatacaccacataaatttgcctggttttatggtaaaccggaagagtgtgccgaacgcctggttggcaagaccattgacaaagcctgcccacaaggcggaatggtcgaactaacggctggagacacgatgttggttttgacagacggggtcaatcttcgttatttcgaaccgggagcgaagttaccctccaaacatcaactgctggtggcattcgatgacgaaagttgcctgttagcatctgtacggatgtacggagcactgttgtgctttacccgagggcattttgacgcaccattggccgcctattacgaaacggccagaacaaagccacaagtgatgtcggacgcctttgacaaggagtactttcttggattggtaaatgcgccggatgcacagaagaaatcggcaaaagcttttctggccacggaacagacaattcccggactgggcaacggagtattgcaagacatcctgtaccatgcgcatatccatccaaaaacaaagatcgacaaactgggcgcagaggaaaaggagaaaatgtacgaacaagtgaaagagacactacaagatatctaccgcctgggcggacgaagcaccgaaactgatttgtttggagttcccgggcaatatgtagcctccctgtcaaaaaatacagcgggacatgcgtgccccaaatgtggtgaagccattgtgaaagagaactatctgggaggaagcatttattattgcaggggatgccaggtaatgaaataagcccctcacagtcactattcaattataaaaacaaaaaaaacaatgaaacaagaagtattatttatcattctcaacgagtatgccgattgggaaagtgctttcgtagcagcgtcccttcattccggactaatgccgggcagtgaaatcaagtacgtagtcaaaacagtagcccccactttggatccagtctgctctttgggtggtttccgtactctgccggactacagtttcgacaaccttccttccgattatgctgccttggtcctaattggtggtatgcaatggcagtctcctgaagcagaacgtgtattccccatcgtccaggatgcttttgaaaaagggaaagtgattggcggtatctgcaacgctgcttcatttctgtgcgcccatggcttcctaaacaatgttaagcataccggaaacacccttgccgtgctcaaacagtggggcggagaacgatataccaacgaagatggttacctggaaaagcaagctgtcggtgataagaacatagttacggcaaacggtaccggttatctggaattcacccgtgagttgctattagcattgaaagccgatacggaggaaaagatcgaagcattttatgatttcagtaagaatggatttgtgagatagcaacatgttcatcaagcatacgggacaacatgaaaaaaggattcaccatactgcttcttttactctcattggcagaagtgtacgcacaaacagaattcacaaccagcctgtttgattcaagacgtaaccggatagtgccggtagctgtttaccggccaaaaaaagaaagcgccaggaccggagtcattatattcaaccatggatatgacggaaacaagaacgataaatcgaaccaaagttattcatatctgactcgttttttggcagaaaaaggatattatgtgataagtatccaacatgaattgtccgatgatcctcttttggctatagaaggaaattttatggaaacccgtatgcctaactggaaaagaggagaagaaaatattctctttacaatccgggagtttaagaagctaaaaccgaacctgcaatgggagaaactttgtgtgataggtcattcaaacggaggtgatataaccatgctcaccgcaacaaatcatccggaactgataatgaaagctatctcaatggaccaccggagaatgataatcccaagaacacaaaagccacggatatacacgttgagagggtgcgattatgatgctgatccgggcgtactcccaaccagcgaggagcaacagaaatttcgaatagaagttgtgcgactggatggagttacacacagtaacatgggagaaaacggatcggcagaacaacacgatcttattaaccgacacatatatatgttcttaaataactaattaattttcatgatattatataatacgccatgacgtaccatgatacaataaaacccataatcataagaaatcagatctatgaagcaacaagaaactaatccagacagcctaattgagaactatcttccggcagattattatgactccttttcaaaagagttgcataataagaatgcaatctccactgacgagtttgcagatatagcttttaaccaactaccctcctggattatccggcttctaaaagtaagaaatagtatagtcaagcctttcgggctcaatacaaacagacgaatcacggatatggagtgtgaaagaaatcaacacgaaataatctttggtatgtccgataaacacttgactttctacgtatccctttggtgtaaggtttccgaaaccaacagccaaactttacgaatcaccacgatagtcaaataccacaaccgtttgggaaaactctactttttcgtgattcgtcctttccataaagttattattcgatcattattggagagagtagaaaaaaggtataaacttatatctctggagaaagaagtgtcttgatatcacgtaattaaacatacttttttattgttctgaaatcttttttactaccggtttatccgcttccgcccagtccaatgttaccatctccccaggaaagagccactgtgcagcaatatgttctttcaatacatattgctccccgataggatgacatagaaaagcgtgcatcgtaatttcgaaatcaggatagatgtgatggactgtcaaaagcttttctcccacttcaatagtataatccatttcttccataatttccctttgaagtgcttcctgcaaagattcacctttctccactttcccacccggaaattcatacctgaaagaagtatatgaaaatttagttcgtccccgttgtacacaaagatattttcctccagacctgataacggctgctacgacttctatacttttcataatgactgcggtattgggtttcgaagataatggatgcaaaagtaataaaagaatgtgggaaaggaggaaattaaaagtaataaagactaatcttaaatattttccctacctttgttaatcaccggaatgtaagtcccataacgataagacaattaacaattaatacattgaaaaacaattatcagcatataaaatgaacaccactccccaactctaccaatcaggtaacagtgcactcatgtcgaagaagaaaattgctttcttatgttcccggcaagtacctgaaaataaaacagcatctatttatcgctgggcaaatcaattattaccggaaagagattgcatcctttgcggaaatcattcaaaaatggaacaagaggtctttaatatactattggagaagaaaataccagtcattctgatactggctgaaagcatgaaagaagaatggagtaatcatattaagttggcactcaaagagaagaggctattgatagtaactgcctgtaatagccaggtacacagaattaatcatcaatcagcctatgaccggaatgaaataatactttcatttgcggaccatgttataatcggttattgtaaaccaggaggaaatatcgacagacaaattagcggaaaaacaaacattacatttttacacaattcgaattacctgccgacagagcctacccttatggagagagcggcagacagtgatgttataacctataggacatccacaaaaggaggagaactctttttagatattaaacaggacttaagcggacaagaatatctaaaaattacccaaagtaaacatcaaggaaataagggtttccacagagaaacgattttcatcaacaaggatgaaatactccagttcaaacaagaattagaccgagctattgaatattggggattgaaccctataaagcaaaaacagactcttagtttcaaaagagaagagtatggcaacgcctatttgccatgggaaaagagtgcagataattatcttctccggttgtatgcggaaggcaaaaccattaacgaactgacagagatattcgaacggaatgacggagcgatacgttccagattacaaaaactgggaattaaattaaaataatgatattatctggttttaaaacgacatctcttattaaatacgggtagagagaaaagggttttacaaatgtgacactgtaaaaaaatgatagaaaaagtagtcagcaattccaaaggcatagaagagaatagagtggaaaaacacagtaaaggacattgcaaatgtatttagaatcactcttaaaagacattcgtccctatatgaattctgacaagaaataatataccgccatccccacctgcaataccccaattaccggtataccatatttaaatttaagatgccgtgtcttatgccgaaacgtatacatccctgcccatgcacctaacgaccctcccgctacggctattcccagcaggtggacttcgggagtacgccatcgttttcgggatgcgttccgtttatcgataccgtacataacaaaagaaacggtattcacgattatcagatataagaaaagtaacttcaacggttggctcttttttaattcgccggcaaagatacgcatttttagtcaagcccgatttgtcggccgaaagattctctgtatctttgcccgcatggcagagagaaacgaattacataaaaggaacaagcataacggacagtacgatttttcaagactgatggaagagtatcccccgttgaagaagttcgtcgcaccgaacgcatacgggacgacaagtatcgatttctttaatccgcaggcggtgaaggcactcaacaaagccttgttgataagctgttacggcatacgatactgggatattcctaagaattacctgtgtccgcccattccgggaagagcagactatatccattacatagcggatttgattcaacccgaaaacccgatacagacagaagcagcaacaaaagccactcacccatgcaggtgtcttgatatcggtgtaggtgccaactgtatctaccccattatcggacaaacagaatatggatggactttcgtcggttccgatattgatcctatctccattgataatgcacgaaagattgtaacttgcaatccggcactggcccataaaatagaactccggctgcaacgggatagccgaaagatatttgaagggatcattgctccggatgaatacttcgatgtaaccatctgtaatcctcctttccacagttccagagaagaagctgaagacgggacgctgcgtaaactcagtagcctaaaggggagaaaaataaccaaagcccggctcaacttcggaggcaatgccaacgaactctggtgcgaaggtggagaacttcgctttctgctgaccatgatcgaagagagccggaactaccgaaagaattgcgaatggttcaccagtctggtatcgaaagaaaagaacctgagtaaactgaccgccaaactcaaatcagtcggtatatctgaacataagattatcgagatgcaccaaggtagtaaaaccagccggattttggcatggagattctgagaaagatatagttactaaattagcaagtatctactcaaatctttcaaggaggcggccttaataaaagatcatccgcaatgcagagatatcattgaggttaaacagtttatcactccaaacaaaccaattccggaaaacgtgttttaacactgtattaaaacttgttttctacaaacaaaagacttgtcctttaactgtgcaaaagaagtcctttgtttgcaaacaatcagaatcattcattccgagttaacactgttaattggaaaactatacattattatgaacatattaatcctcagcaatgctgacagttgccgcagccggatcgcacaggctcttctttcctcgtttggaaaaggtatgaaaatatattctgcaggaacagcacccgcagcagaggttcatccgcttgtcctgaaactaataaaagagacaggtatcgaacctgacacacgacctccccattccatctacgaatataccaacaaaagctgggatactatcatcgtcctttccgagacaaccgatgaaatccgtaaccacttctccaaagaggtaaaacactggtattatcttcctttcgatgaactgttccctaccatatcggcaaacggaacggacctatgggaaggcttgctccgcctgaaagaagagatcggcaagaaaatatacgaactgtatcgtgacgaactgaaggagcagttgctcccgcgatgtacttgcggagccaacgacttttgcagatgtgagtgagggaaattactccctcacctcttgctttatcagccgtgtcacgcttgtaatatttcgcttgtctttattcaggatataagtatatttgtaatcgcttgcccggtaagaagtaggcgagctattcaccaagataatattccggttattggcaaagtccaaaatacctttaatattattgggatgcagttttccgatctcgtccatcatgcagtgcagcttgaagtcgttgaactgatgcgatgccttttccttgaacacattcagcaacatgatgttaatcatggccttcaccagaatatccgttccgtcggaacctacatttgccagtttctccacccatccgctgtcattatcgttctccacaatgcgaaactgaagttcgaaagtatcagaaagcgtcagttccttttccttgttcagtgccagttctttcaccagcgactgcaataaacttaccgcctgccgattctgttccacaagctcctcctgaccgaacaggctaaacatgcccagagcacccggttgattccggtcgcaaaactctttgatggtaacaaaatgttgcatgatacgattgccactgggtacaatctgtaaggcaatgcttttgatgaccccggcgaaattgcgttccacaaagtcactgttgatgtcgttgatagttttgcgaatcaacccttcttttgaaagcatatccgccgtctctttcccgatccggtgaatcaagtcggtatatgcttcattcgaacgacgttcaaagtcaatgatcttatcattatcaatgaactctttgagatcggcagcaaaggtcataaactcatcgcgctttgtaagacgtgtacggaagttgaacgtattctgttcggagaagttacccgtaaagcggccgaccgcttcccggaagtccttctcttgttcaatctgccgataatgattctgtgtcagctcctctatcactttcttgcagcgcttcacactctctgcttccactcccgtttgcagtacaggcggacaaatattgagtgttttgaagttctcagtctcccggatatcctcttctaaatgcttcaggcgggtatttgtctcagctaattgcttgttcagtcccgttactttctgattcagttcttcttccttcaagcggaacttctctttttcaccgtccagttctttctcagccaactgctttccatttctgaattcgtccatacggtcgaagaattcccgcttatccttttcgtaatcgtaaaccagacggcggtgctgctcgataaacgctaactcctgttccgtgcgggccacttcattacgcagggcagtgatacgttccgtatccaccccttttccggaaagttcatgcaacaggtccttatccattgtctccagcagttcatcggttttcttcttttcagaagcaatggactgatggatctcctcctgcttgttacggatcagagtgtcttcttcctgcattctctggttacgttccttctctttctgacggattcgggtttcaagcaagtgattgaactgttccagttccgccgctgactcctgcaaactgtgtgtagcctcagccaactgtttttccaactgttccagcaatatacgtttctcctcgcctgccttctgctccagtatgatttcatctgctttcagaacctgaatacgcttatcattctgttccatacagtaagcggactgagccatctcttccttataagtattaaggacagtctggtgtttcttccggatggcagccagctctttctctttttcctctatcgacttctcaagattctgctgccattcatgtatctccttacggattgcttcctgctctacggcatactcctgcacactcttcacttctttccggatagccgaaagatcgagtttgatgccatagaaagagtcttgtccggtatccggaacagattggggattgagttccttactgaataaaacaagtttttcgtctaccaccttaccaatggtattctcccatcccggacaatttcggctcaaccattcatagagtgatccctgacagttatcaagtaaccggtctatctccgccactttttctctaccaaccgcaatctgctgctctatttccttctgacggacgcccgactgttgctcacaggcagtctgatccagttcccattgccgacgtaccagccccatttgttgttctgcctctttcagcttcaaccggcattcgtgattctccttttccaatgcaacgcgttccgtccggcaggcctgtaactcttcttcatggaaagtccggtgcaggcacttctcccgttccatcttcaactgatagatgccctcttttttcttttctgtctgttctcgcaggagggtcaacttccctacttcctgctcacgcacctctttcaatattttatcgtactcctttcgtacagcctccttacgttcgatagcacgtaaatggagcgtattcagctcagcatttttaccgttacggaaacgttcaaaggcactggaagcctgttccttcagtagcttatactggctgttgatgtcgtcaaagcgggcagtcaacatggtcagctgctcctccaacatctgtttgtggagtatggcttcgggctccgcattcacccggtcgcacacattataaatatcctgcgactcataccgttcctttcgttcacgcgcagttttcaagttctcgttctgtaccctgacaagccccagcaaacggtcgcgctcactctggaatttcccggaaagttcctcaagctgatgtttctcttttgccaactctttcaacagttcctctttcttctgttgcagtgaagggagcagttcctgtgccatccggaaagtataattcagttccccggccagcgtacgcgcctgttgctccagataatgcatttccctataaagctcaattacccggtcagcctgccggcgaacagtaacctcgccgttcttgttcttcctgaaccacttgctgatatcagtcacctcttcatcgaaccgtcgcagatgatgggcatattgccccagatcgatacgcacatcttcttcgttcagtgacatgatgatggtttgcttgatgaactcagcatcgagctttgaattcaggaaaacattctgaatggtacgcggtatattctggtactgacggctctcggtaatggcaaacttccgtaactccggaggaagcccccggttgttgccgaaaatgatgtcacgatactcctcatacgtctctacgcgacggctcttatagacaaagctgccaagggcatcgcgtatctgatcccactcttcgtaagcctttccttcgggagaaataaaatattcttttttgtaacccgttcccagaaaacggaaacaaactctcccctgggagcgaaaagccaacacacaatacgatgcatcgtctacggtcacttcataaataatatatgaattgaggtacggaaagtaatattcgtcaaagctctttttctcttttgatatgcccagcttcgtcttgtcggcattgtaaaagaaaagcagcgcacgtaacgccgtactcttccccaccccctgtgtaccgataaagtggacattgccgtctatctgtatttcggcatattgtatacgggcactattgatgaaaacaattttattcaggtatctcattctgtatttcttctgatatgttaatacaagcgaccaactcttccagatagccgaaagccgctactactttataggtggaagtgatctcgttctccaattcaatgaagccgtcacgtttcaggtcattcactattttatcgatcatctcttcgtgcttctcccgtccgacaagtttcttcaatccggcgagtttctctttcagttccaggtcggtacctacttttacgaccatatcggccggctggaaacggaatccggatgaaaaagccgcatcgtaggttttaatgaaatcaagcacatcaatccagcgggtggcaatctctaacttacgctccagatcgactttattttcccgacgggagaaataataatattcattcccgctctcaaggataaagttgatggcggcaaagaaatcgtacaactccgactgattatcttcgatcaccgtatagagttggcggatattgggattggtactgtcggaagagatgaatcctcctttactcagtatttcaaatatttcagcagtttgtttaatcattactataatggttatgggttcgggttcaccaccgaggagacagaggacacagagaatatctttctcttaaacatcctgataaacaaaagattaaaactctgtgtcctctgtgtcctcggtggtgaatcgtattcgtttctaaactatttcgcctgtcctttccgaataaatcagtgcatattccaccccacccattctgccataatcaccggtgatacggagttcttcgtaaaactgggatacaatctggcagtagaacgttatccgctcatcaaaagaaacctcttgtgcgaaaggataggcagtcacaaacgaaaacaaatcttcttcagcctgcataaaccgcttcttcacttcctccagattgatataagcctcttccgatatatgggtctcaagagagtcttcggcaatgctgccggccacattccgggtaaggatggcacgcttgccgatcatggttatcactttacggatgctctccaacacttcatcatcattacgaagatattctacggaaagacgtaacggataagccggtgcaggttcgaaccagacactgtctttctgcatcaacacctcgcagatattggttcgttcctccagttcgaactgatctttcaggtatttcagctgccggatcttaacccggatcttgttctgatactctattttgttcagatagctgataatctgcttttgtatctcgatcaggttgtggaaacattcattgagctgtatccgtacgtttgccaccacaatccccagttcctcgtccggtatccgccggaagaagcggtcttcttcattggcaagaagctcctcgctcacttttatcaatgcctcgatatcccgccgtttctcgtccaggcgaaccagttttttcttcttgatctgatagttcggctcattcttgaaagtgctgtcgatgttacgcttcaggtcgatcacattgcgcaaggtagtcagggcgatattacgtaatatccgcttgatggtacgcagataggtagttttccgtttctcgtggttttcttgctgataataggagatagtatctttgagataactgatatgctcgttgacaaacgaagtgttgatctcttcgttcacttcgagtacctgctcgaagaaatgcagataaatatcctccatctcaagaaacgaaccattctcacgaagcactccgtgatcgatcaggctctgtatacgttgtagtttatattctgtcagttccagtgcatattcccgccggaaggattgctgtttccgcttgctgaacatctgtttcagcaggagctgttctcggctcatcatcttcagcaactcgtcgatagagtgaaatgtagtcatgtataacggctataagcttttcaggattccttatcttatcagttttttcttcattccccgggctaactcttccttgataaaagtcatcaatggcttacccactacaataaacatgaccgctaccagaatcatcagaatgccaagcattaatctgggagtcagccgttcgccaaaaatcatcaccccgaagaaaagtgccgtcaccggctccaatgctcccagaatggcagtaggcgtagagccgatgctatgaatggaaacagccgtacataccaatgatatgacggtaggcaagaaagccatggcaagaatattgccccaggcaggaaacgaaggaacagcctgaagatccgcgcagaaattcaggcggactatataaatggaaagaccgaacaacagcgcgtaaaaagtcagcttggccgtagacatcaacttcagtgtggaatggttgacaccgactatatagacagcataagacagtgaggaaaggataacgagcaacatgccgaccagactcagcgtttcgcctccctcccctttgtaaagcagtccgatgccggaaagggcgagcaaaatgcaaaagacggtcagcaacgacactttctcgtggaaaaacaggaacatgataagcgccaccatcaccggatagacaaataagatggtggaagcaatgcctgcatccatgtgcttatagctcagaaacaacagcagtgaagaggcagaaaaaagcagtccgcctgcaaccagaggcaatatctcgttccttttcagagcaaacgactgtccctgcactttcatcagaatccccaaaataagtacggcaaacccgtaacgatagaacaatacagagtccaccgacatcccttctttatagagcggcagtgtaaacaacggattcatgccgtaagtagcagcagccacagctccgcaaacaaatcctttagccttactattaatattcattattatattcaattttcggggtgcaaagatacagttttttggagatgttggttacttttgcgtcaattctaacagagattaaaattgagcaaaaaccgtattgatcaggaaaagagagtggtagagctgatgatccgtctttactgccgtaaaaaagaaaagaatgtcacgctttgcccccaatgcgaagagttgcttcgctatgcgcatgcccggctggaccgctgcccttttggggagaaaaagaaagcatgcaagcaatgcagcgtacactgctacaaacctgccatgcgggaacggatgaaacaagtaatgcgtttctccggtccccgaatgctgatttatgcaccttgggaagcaatcaggcatctgtttggataagcagacacagagaagaatattattattataattgcattattactttataataattatctttgcttattaaagtaacgaaccatgactatcatcagaaacccctttataaccagtggatatgtatcttccgattatttctgcgaccgggagaaagagagcgaaaccctgatccgggaagtaagcaacggaaacaatctcgccctgatctctacccggagaatggggaaaaccggattgattcagcattgcttccgcgaaaggaaaatccggaaggactactataccttttttatagatatatatgccaccaaatcacttcgtgactttgtattcgcactgagcaaagagattctggaagaattaaaaccttccggcaagaaagctttgcaactcttctggaaaagcgtcaaatcattgcatacaagcgtatctttcgacattaacggcactccttcactgagtctgggactgggagacatacaagctccggcaacaacgctggacgaaattttccattacctgaaccatgccgataagccctgcctggtagccatcgacgagtttcagcagatagccggatatgcggaggataatgtagaagcaaccttgcgcacctatgtccagcattgcagcaatgcccattttatctttgccggaagccagcgccacatcatgggaaatatgttcctcaccccctcgcgcccattctatcagagtgtttccatgatgcatcttgaaagtattcctttggcaaaatacactgctttcgcgcaactgcacttcgcccaagcaggaaaaagcatcaccgatgaaacggttgaaaccatctaccgacgatttgacggcatcacctggtacatgcagaaagtgctccacacactttacgacatgactcccgcacagggaacctgtgaagtgaagatggtggaggaggccatccgccaaatcatcgactcgttcaagttcacctattccgaaatactgttccgcataccggaaaaacagaaagagttactaatcgccatcacaaaagagggaaaagcgaaggccattacttcggcagcttttatcaagaagtacaagctatcctcttccagctccgtacaatcggctctgaaaggtctgctcgaaaaagatttcatcactcaggagttgggaatataccagatatacgatcaatttttaggtatctggctaaaagagaactattaagtccttcaaaagccaaacactccaagaaagaatttccaatagatttctttcaaaaagacagtaaaaccccttatctgccgacagcctccatttacaaaaagagacaaatagagagatggagcaacagataatgaaaaaacatgcaaggacaagcctttattctctcataaaaatgcaataaaaagcagatatatgcagtcccccactctatcagagcctttgttgacagcaaagaaagggtgcgttagtcccaaacggacggtgcattggcttcaaagagacggtgcgttcctctacgagcaacgccgcacgggtaaaaaagaagagtaagatgggctgtttacgaactatcagagccaccgtgccgcacgaatcaaatctactaaaagaaagtaatcacacacaaaaaagatcatttactaagatcataaaaacatatatcacacaattttccaacaataccccaaattctccatcatattgctttaccttaatcctcctacaagcgttttttcagtcgccacatcctccgggcatgaaaccaagactgcctgagagtgatagaatatacaaaatgacattttatcgccgctacaatttcccctcctttattctgccaaccttataaaaacagcattttaaaacggaaggtcgcattttagaaagatttaattatctttgttgctgcaaacccagttatatttcaccttttcgtaaggaaatgatatacacagcatcctccgccgccgaccaaaccgcctgctggattacaggcattgttattgctgccctgatctttctttttgtgaagttcgcggcaaaaggcagcaaaccattggagaagataatgctggcatcgggctgcgtaatcgtactgctgactacactcatcgtcaaggtgccggcacccgacagcttcaacccggaaaccggattttcggagaaagaaagaagaaaagacagacggatactcatacgaatattctcgtccatcgggctgacagccctgtggttcataccgatacggaacactgaatggttcgaagccctgattgaaaaacatatctgggtgactcccgcaatgctggcagtgttcctactcgcaggatggatccttaccggacaactgacccgatggtacacaaaagagcgccggacggataaacacaccggacggaaaaaacgttcttctcaaagaaacagaacaccataaaagtaaattcaaatatgaaacgagccgttatcataggagctacttcaggcattggacgtgaagtagccaaacaacttctcctacagggctggcacctcggtattgcagggcgccggcttccgtcactcgaagctttgcagagcagcgcaccggaccgcgtagaagtcgccgcactggacgtcacccaaccggatgcagcccccaaattgagtaacctgatcaggcgagtcggaggtatggatctgtttctgctgagctccggcatcggttatcagaacatagggctgaatccggacatcgaactggaaactacccgtaccaatgtggaagggttcacccgtatggtggacactgctttcaattacttccgtgagcacggcagcggacaactggctgtgatcagttccgttgcggggacaaagggattgggagtggcacctgcctactctgccacaaagcgttttcagaacacctatatcgacgcactggaacagttggcatgtatgcaaaaactgaacatctgttttacggacatccgcccgggctttgtgtctaccgacctgctgaacgacggaaaacgctatccgctattgatgcaaccggaaaaggtagcccggcagattgtacgggcattgcaccaccggaaacgagtggcagtgatcgactggcgctatgctgtcattgtctttttctggcggatgattccgcgctggatatggaaacggctgccgatacggacaggaaagactatgtgacaagaatatatatccctattgaataattcattaaaaacaaagaaagaatggaacagaaattttgccagagctgcggtatgccgcttagcccggaagtattgggaacagaaaaagatggcagcaagaacgaagaatactgcacctattgttatgccgacggacatttcaccgtggattgcacgatggacgaaatgatcaaccattgcgcacagttcgttgacgaatttaacaaggattcggaagtgaaaatgacgaaggaagaggccattatgaacatgaagcaattcttcccgatgctgaagagatggaaacagtgaaacataactcaaacagacatctgtgacgcataaacaaaggagagtgtgtcaaaactcaccacagagggcacagagtaacacagagtgaattttaagtcatcgatgattaatattctaatctgtggcaatctgtgtaatcctctggtgaaaaggcgtttgacacatctcctgctgtatcggaagaggtaccgtttattccaccggatgccgcttcagccaggctacagcatacgaacatgtcgctttcggtttcagaccttgtccggcagcatatttgtaggttgcttctaccagagctgccgcaatcccctttccttccagagggggaggaacgatggtatgcataatgtccagcgttccatcttctacttcatactccacaaaagcagtcattccattcttttccagttcaaaacgattccgctccgggcggtgagttacttcatattcttccattttccaatctcctttttgtttaggttaatatagattatttaaaattcttctccctctgctccacccaaatcaacttatccacatcataccccctgcggatggcagcatccagtaatttcttctttatctcttccggcagaatgggcgtacggctcaatatccacagatacttgtccgaactgctgccgatcagtacataattatactcctcctgatccaactccaaaacataatagtctgaataaaaggacagaaaaaaggataccttcagtttgcccggttgcgacgaatcgggaacctttgcccgtccttccgctgttttacagacatcatacggctttttatgcttacatccccggttctctacgcgaacggttccgtcgggcagcaatgtgtaagttgccgtcacctccgacagtccccgctcaaagcggtggtcgaaacgggctatctcgtaccatgtacccatataacgttgcagatccagttcgtccaccgtactgtggtccgtgccctcaaaaaaggcttcgatggtcggtttatcaaagcggaaacctgcctcgagcaagcgtgtgggacgcacattctgccccgacgttaagaaggaagccgcttcaccatattgcatccgaaaaaaccaacgtggtatcaccaccttcatccaggcatgatagcgcgctgccatcgcccgggtaaacgcatattgtgaaacctgttgcggaaccaccagattgaacactccgcttaatacttcgtggttgatgatgaactccatcgcacggcaaagatcctggattccaatccagggaaaaggctgtgtgcccggagcaatcacaccggctacccgtgctatccgaagcggacgcaacatctgctccattgccccgccatcgggtgagagcactatgccaaaacgggtgatagccagccttgtctgtgaaggacaacggcgagcctctttctcccaggcgtagcaaagttccgccaggaaaccgctgccgcgggtattggtatattcgtcaaacgtcccatcttccggataatatcctacggcagaggcggaaatcattaaccgcggctttgtctttaccgcatccatggcccggatgatgcgatgcgtcaccttgatacggctgtcataaagctctttcttatactccggcgtccagcgtttactgatgggtgctcctgccagattgatgattacatcgcaatgcgacaaggcctgaattaaatgtcccgatgtaccttcacgaaacatgggtctccccagagggactatccggtgccccctttccgtaaggtactctgtaagatgcttgcctatgaaaccggaggccccgctaattgctatattcatctgaatctcctttttttaggaatataacgcaggcaaagcgggtaaagttcacctcatagtcatcttacgcaactcttcgagcgaaccgttaaatacattcaaatctacatcatggtgaataccgggcacacttccgatatctgtatgctgccagaaatgccattttccctgatacttcaccgagtcgacatagtaatgggcaatccaatagggataggcattgaaaagcgaatcgtccagatagtgggttttgaatttatatgaagtatagaggataggcttcacaccataatgcgcttccacccggtcgagccatttcttgatgctctgctgcaactccttcttagatttcttgcctgacagctccacatcgagcaccgggggaagatcgccactatcgagctttacggtacggataaaaaagtcagcctgcttcaaggcatccgtacggggagtaaagaaatggtaggccccacggataaagccatgctggcgtgcctgttcaaagttttgcttgaaggtatcatcgccatggtcgcctccttcggtggccttcataaaaataaagtgaagcgggaaatcagtctccttgttctgtttcagttcctcccagtcgatgtttccctgataatgggaaatatcgataccatgcacttcgtaaccacaaggaatgcaaacgccatactctttccgcccgtagcattctttccagcgataggaataaggacggataacgaaatagtaaaaagcaacagaaaacagaccgacaacaacgagcgcaagggtattgcgcaaccaaacaggcatgatacgggaggctttctttttcgcttttctcttccgtaccgacgtatggcgacggggagcgggtttattagaaacagaagtggttcgtgaagacttcattgattgtattcttattttgagttggattcatttctaaatagtgccatcagcttccgccctgacccattccagataaatgcccggattagcctctgctggaggagcgataaagtgaacataactaattccgttttgcgacttgtttctgagtggaagacgcagggaccgaagccgtccgtctacccggacacgtgcctgcggacgtttctgagacaaatcccattccaaagaaacttcatgccaacggtcatctttcactcccagttgcttgcgggtcagaggaagttcgtacatcgattcatagcgggccacggtgtccgaaggattcatccagcggtcattcagtaacaatgaaaccgaatggcttccctctggaatacgcaggctgacagtgaacgtccctttcttcattgccgggaagttccacactgccccacgtgtatctgctaccagcgaggcatccggctgataagacaaatggagcacctgacaaccctctttctcgggatgggattcgagccggcacccctgtatgcggttataggcacaatgacctttaatgccgtcgatataattgaatgtgctccattgcgaaagagaatcgctgaaattattaaaacggcttttctcgtacagccaattcacgtcgaacatcatcatggcacgatgaaggggatgttgaccgatggacgccagcaccttgcccggagctacttctacaaactgcgcctgatggacaccacggtcgattccaccgccattgacagcataatcggagtcattgcgcatggggtccatataaagttcacgaaaacctgtccacgtcttgccgtcatcatcggacacagctacgtgagtcacgtcgcggttggtgaaaacatcatcccagacaccattcgtcccttctttttcaggcagaggagtagtattgcaccagaaaagtaacagtctaccgtcggccaacctgccaagggtgggcatcgtgatagtaccgtaaaaaggcgaaggttccgattcactccatgtcagaccaccatcttgcgagaaagcctggtaatggcggtcctgtgaagtacgcatcagcatccagagtgttccgtctttcagttcaaccacagtaggctccacagcaccgtgattccaacgaatacctttgtggaagcctcctccccgatggtcgggcgaagtgactgtattcgagcacttccaagtcagtccgtcatcatcggaaacgtaagtataacagcctttcggtgtcacgcctccatgggcagccaccacaatacgcttgccgttcctgataaaaacgggtggtttaatcatgatggaactgcgatcggccactttcgtaagggtacgtccgcctgccagtccaccggaagtacgaatgcaataaacacccatcgcccccatatctaccaaacggatatactctttgctcacagggctttgacggtctgcaaaaggcatctctttagcccggtttacccgtttccaggtcagaccatgatcggtactcgacagataaacagctcctgccactgcctgttctccatagttgtaatgtcttacttcaccattgtcaagaagcgacagaccgatataagcatcggaaggcggagtagctactttcaagggagcacagaccgaatcgagcactaacggacgggcttgctgcgcctgccccgaaaggaaaaaacctgccgccagcaggcatagagtagaaagtcgtttcatcatataaataaggatattcaaatgaactaaaaacccaccgaagggaattgaatcaatccgccccgatgggtttctgttattgtaatgcggagaacagcttacttagcctgttccagctgcaatgtcttagtcggctggtcgcaaacttctgtcggaccgaagtactggatcggacccggataaacgtagtctgtagtcagcgcccactgatcgcgtttggcagcaaatgtcaggaacggtttgccatccagtttcaccaatgctttctggattaccggcttcatttcaccgtgacgacgttccatgttcatcatcatcgtgataggcacaccgcctgcgatccattcggcagcaggagcagttgtgttgcgtacagatgacatgtaaccggtcttaccgttggcaatcagcatagaagctgtataacccagtgaatagcaatagtcggcatcgtagtttgacggagcagcacaacgtccttcgtaaccgaagaagtggtgctgtgcagcaaacttgcctacatatttgccttcttctttccactgagccagtttcgtaccaaccatttcagacagcaatttttctgtttcaatcagtgatacctgtacgtttccgtgcgggtcgcggtccagagaaagctgacgtgccacaccttcgggaaggcttgcatagatgtcagcattttcttttgacagcttgctgatgatatattcacgttgacgagaacgtttgatgttggcgaactcaactgcgttagcagccaggaaatcgttcaactcagcgatcagacgtttcatagccgggataaattcaaccagaccttcaggaatcagcacagtaccgaagttgtttccctgagcagcacggtcagccacgatcttggcaatgtaagtcactacatcatccaatgacatgtcttttgcttctacttcttcagaaatgatacatacattaggctgaacctgcaaagcacattccagtgcgatgtgagaagccgaacgtcccatcagtttgatgaagtgccagtatttacgtgctgagttacagtcgcgctggatgttaccgatcacttccgagtatactttacatgcagtatcaaaaccgaacgaagtttcaatcatgtcgtttttcaagtcaccgtcaatagttttcgggcaaccgatcacttgtacaccggcattctttgcagcataatattcagccagaacacaggcatttgtattggagtcgtcaccaccaatgattaccagtgctttgatacccagcttattgatgatttccagacccttctcgaattgttccggagtttccagtttggtacgtcctgagccgatgatatcgaaaccaccggtgttgcggtattcatcaataatatcggcagtcagctccatatagttatggtcaaccagtccgccgggacccaggataaagccgtacagcttattgtctttgttcagtgttttgataccgtcgaacagaccagagattacgttatgtccgcccggagcctgtcctcctgaaaggataacacctacattcatggcaggaagctggatagcttcaccttcttcgaatttaatcaacggcattccgtaagtgttcgggaacagtttctggatagcttcctggtcggctacagattgtgtagctgcgccttcaactgcttttactgagcctttcagcgctttcggaagtttgggctggtaagcagccctggcaatttgcaatgcacttttagtcattttctttatcttatatttaaaggtgttagtaattcgaacttaaaagcgtcgcaaatttcgtgtttttttccgaattatgaaagaaaatggtgattttgttctctgcgggtatgccacagagcaaacgaagggcacagagctaaaatcaacgatctgaactctgtgcccttcccggctacttaaaggtatatctaacttcctctttaaaacgtcaccactgtcttgtcgcctgtagcagagacggcatacactttaaagccgtccttccaggctgttttcatggtaaacgtggcagtatttgagggtgctaatactccatcggagatacaaacctttttacccgtttcatccactacttcataagctaccacatttttccaattggtcatggtaaatgtcgaaccgcttcgcgtagctgttccggatattattccgggtttggttttatagagttctaccgaattatcagttatatactctaaggcaacatccggtttcggatatcccaaagcctctacacgcttttttatctcgtcgatacgggactgagtgacagtaagttttccaactccataatcgtccagagtgacatctatcggagtcaggaatccccatttcgtgaagaaatccagcaaattggctttagctatcaaactacagatatacacaaactcagtctgttgctctccggcagtcttcaggttatcgtgcgtacgtatatattcgtacacatccggatagaatcctcctttatcagcctgctgaagcggtgtctgcccaagcactttgccaaaataaagctccagttgccagaaaggaacgagtttgcagaaaacatcactgtcactgccaaagtttccgtgaggagcacctgccgcgatgatctgggtccaggctttggaatatcggttccggctaccatctcccatattttctgtctgcaggcgtgaaggctgcccgaaaatcgtagtctgaatatactccgacataatgttattcgtcacttccgtagttcccagccatttcaatccgggacgtgtctggttgcaatgccctatttcatgtgcaggcccccagcatgaagaagttttcagtttatccacattacaaagttccgccagtgtaccgtcattgtacgcggtgtgataactggtggcatacatatagctggtatacatcacatgcagatacatgcggtttttaaacaatttattatacttatatagccccatcagttccatctccgaattcacgatctgatcataagcatcgatcaatgcttttccgtccggagtgtgagcacggaagcgctcggtaggaaatgtgagatgtgcataatgtcccaccacatcaaaatacttatcgaccgcattgctcaacaatttattccaatcggaagcctgatgtttggctacatcgaaatacccgttcacctgtccggaagcaatgtgtatctttacaggctgagctgtttcatagtcaggggtgtgatacaaaatatacatcaatcctttattccgggccgtaatcttgttggctccttcagacaacggatagaaggtacctccgaagccgtcaccaccggggacgtcaaggttctgaatcactgcactgataatttgcccgtgcgtatcgccgaccaagaccatcaactgttccccgtcttttaccgaaattcccgtaggattgtcgcgcaggctgtagggactggtcttatgtgttttcgactgatcatccggattgggccacgctttataatcttgaatacggaactctgtcggatacttaccttgcttcatatagtaagctatgttcttgtagaatgaataaggacagttttctatctcttcatcggtaagtccgggcttcagctcagaacaagttacatcagtgaaaagagttaacgggtcaaatgctcccggattctttttataaaattccatttcggcacaggccgcaaatccctgtccgtctcccgaacctgattttacaataaactgaacggatgtgacgccgatttgtgccttcggaaaattaatacggactgcggcattggtacctccgaagttcttagtcatcaaagtattccattcatcggcccctctggtattcgcatttgacttcacacgaatctctacttccttgaagttaccattcggtcccgaagtacggggataatatataaaataatccatatccgaacccgcagggaaattataagtcaacgtgataggaaaataatgctctcctgcgttattccaattagagtggtaaatagtactcatatctccatcgaatgatttatcaatatttgagcctccctggaaagaacttgcctcgcccgattctaccggaaccttaatatcgtctttaataccttccatatctccggattcatattctcccagtcctttttgagtaacagataccagagcctcaagctctccacctacctcttttacagtaatattgccagtgcgttcaccgtcttcaggattggccaagacaatatatctatgtgttgtagtcaccatttcggatgcacgcgtatccgccggtttttctttgacccattccggcaatgtaatcgtcaccggcacgtttgtagttacatcgaacgcaatatcacttccgctggcctcaacagtaaatgtctgttgggatatcagaatagcaggatccgatcccaattggcgtacgttaacagtttccgtcaatgcatcggcagtcactctgatcactgcctctctggtctctttcccgtcatatccggatacattcaccgtcaatgtacttccgttgacagcaaccgaacaccagtccttatcagaccgtgccgtccaattatccgcatcggtgacaatagcaatgtcacgggtccctgcgtcacttttaaagtcaattgcagactgcgccacctcaagggtggtcgatgttaccattttctcttcttcggcagaacaagcatacagcaacaagggcatgattgctgcaaaaatcattgaaattagatgtttcttcatgttattaggataaattaaacataagataaataaaacaaaggaaatacaaattttgttctggtaaaaaatgtcatttgtatttcctttttgataattatttgattcttctatttagcatcaagccgacagccaccggctgcgcagactcatgctactttatttagtccctattgaatcctgttttattcaatggtagtctctccggtttccggatcataggttttcacaattactttagaaagggcgagttcggccagcgcaatccaattggaaccgcttgtagacgatttcaccttaaaccagagataacggtaagacgcacccgcttttataatatccgactcgtaagatgcagccttggtattgggcaaatcacttaaagacgccaacagggttgtctggctttcatcgtaattctttccatcaaaagtattgcttcccagaatatccatctctttgggattatccttattgttattatcacgacaaacataagagaacaggaaagtagacaaagcattctcctcacccaagtcaaccacaatgtaatgtgggaaaggtgtgggactgctccatgacatgtgaaaataagtgtcgttctttccatctatcagattggcgataggaccttcactgctttcctgatcatccgtatacaactgtttagcggacaaagtcacatcactccggtctgttttaatctgcttcggggcaggcaaggcccgtgctgttatactgcaactctgtgatccttcccccgcacggttgcatggttgcagtgtaaagtcaatgtcgccatagcggtgcaacaagttatccaccagcatggtatcgctcttcacactcgcaagtctcaggcatttctttccgtcttccggcaacgtataagtcactttcacataataataattggaatcagccggcactgtccatttcagttttatagccccggctttagcttcagccgacagtgaattctggtctatagtggtcggcatggggtacttctcgtcactggagcaccctgtcatatttatcaggcccagtatcgcacataggccaagcagtatttttttcatcttcaattctctttataaagattaataacccggattgtttactaatttttcatttctattaatgtcgtcagaaggtatcggcagcagatattgagtcggtgcctcaaacttacgttcaaagtcaatcgtcttaattgccgcaaaatcttcaatagtggtggcggcgatattcaatcccttggctttagttccaaaatattgctctgccagcaaccagcgacgcatatcccagaaattctgattctcaagatagagttcgttcattctttcctgacgaacaatctgacggagctttgtctgatccaatgcagcaacgccactccatgcattttctactgtggggataccggcacgctctcttactttattcaagtattgtttggcagtttccagatcgttggtttccacacacgcttcggcatatgccagatagaggtctgcaagacggataataggccagggatatgtattcaggttggtcgaattggtagatacaaccgtactggggtcgactccttttttattcagataaccacttggagtataatttccgggacgttgtacggtcgcagtaccacggctacagttacctcccaaaacaaaatcacatattaatctgctgtccgaattgtctttttttccgttactcatcacataagcgggattagtcgacccgttcattacttcgtaatatcctccctgaaaagctacccaagcataaaaacgaggttcacgttccagattgaacagaagcgttttactaccttcatgggcctcatcagcatggtcagcatccacatttacaatcttcaatttgtctttatctttatactccggatcttcatcccaaggcaaaccgttcttggtatagaaacgattcaacatagtccatgtcgggccgataccattccatgcccagccatcagtcacaaacggcaatgacttattctgtataccgtatgaaccttcgctgcgggtttctgcaagcagtacttccggattacgagagtcccaatcgaccaaactggtacgtagacatcttacggggccggctgccggataagggttcgcatcctcattacctatcttatagtcttgcttcgtatacaaagcatgcccattctgctcggcaaggtcaatcgcctcttttatggctgttctcgcttttacccatttgttggggtcgtaagtaacaggcattaacatattgcccgatttgtccgcaaagttactgtagaatgccgagtttccgttgaacaacggagaagctgcatacaacaacatcttagctttcaccgcttttgctcccacactggttgccagtccgtaatcttctttattggtacgtatggcaggcaatgaagctgcggcttcatctaacagattacatatccactctacacattcgtcatagggagtccgaggcaaatattctgcctgcgaagcatttacattcggcagttctttaatcaagataataggtccgtagcaacgtgccaattgataatgataataagcaatcaggaatttaacctgtgcaatataatcagccttcacactttcagtcagatcgggtaccttgtcgacattctctaaaaacaggtaacattggcgcaatccctgaaagaatgtattccaataagaaatcaccggcgacgaagccgtatagtttcctttcggaaaactggcaaacgtttcatgttcaaaagctgtaatcacttcatctcccgtcagcaaatcaagacttgccgacgctacattgctctgaggcagataaccataacaagaataaacaaaattctttgctgcattccgatctttaaatgcatcttcctcggtcgttatttcatcaggaacgatattcaggaaatcacatgaactatatcccagcatcaggaaaagcaggaacaggagtttatatattatcttcataagtatttattatttaaaagttaattgaataccaacattatatgtacgctgtgtcggatatttcataccggcacctccacccatttcgggatcccacaacttaaatggagaaaaggtcagcaggttacttccattcacatagattcttgcccatttgaaacgatagccaatttccgcattccgcaatttcaggaatgaagcatcgcgcagccaataggaagatgatgcagtattgttgttattattatattgtgtcaaccttggatactttgcattcggattctggttatctttgctccaatggtcatcagcaatccacttcaggacattacttttactctgtgttccaaacggttcgaaaccactcatcattagtgacacatgggtttgtccctggaagaagaaagagaagtcccaattcttccacgtaacagaagggccgaatccgtatattatctccggaattgtgggataccccaataccactctgtcatccgatgttattttcccatcataatttccgttagcatccggctggtctacatatttcacatctcccggcgcaatggcaatattgccgatagtcgactgagggttattggcaatatcagcctgatcaatatacagcccgtctgctacatatccccaaatagagttcaagctctttccaacctgcgacaatgccggacgaagtcctgccgcttcatcgtatttcaaaacttcattgtgcgcataggtgaatgttcccttcatctggatagagaggttccggttcacctgttttccgtagtccaaagcaagatcaaatccagtattcttcactttagcaaagttaccatagattttagtactggcagtccccaagtaattcggtatcgaatttttctgttggaaaatgttatccctgatctccctgaatccgtcaacagtaatatttaatgaattgaaaaactgcaaatcggcacccacattcagtttatgtcccacttcccatgtaagttcgttattctggaaacgattataggtaggacccgataatgaagttgtactcccgccatatccggttgtataagacgggctgctgttcagattcacaattgccagataagcaaaacggtcactaccaatctggtcattacctaccaaaccatacgaaccacggactttgaaattggaaataaccggtttaatagacttccagaatttctcttcactgatattccatcccaacgatatggatggaaacaatccccaacgatgtcctttggcaaaactttcggaaccattgtatccggcatttacttcaagcatgtaacggtgatcgtaatcatatgacaaacgtgcggcaacacccatcttacgtttgggaagtgagccaataagactgctgtttacatttgtattataatcatcctggttataaagcagcataccgcttacattgtgtgaaccgaaggaacgttcgtaattaagatatccctgaatgtaaaacctgcggtcgccgttagtaccaaagaaagcatccatcgtatgattgctcggttcaccgataggtgtattggtaaaatcataggaaccgtcttcattttgtttatagtcggaaagctggtaactattgtatccctgcagacggaacttctgattgtagctccaattcttaaatgaaaccaaagccctgaagctcaaacctttcgtaataaaatccagtttctggtcccaattcacattggccactaccgtgctctcgaatgtatctttatatcctgcacttgaaagggctaccgggttgagcggttgatagttacctgcaagaatacctccccaatggtaccatgtatccgatccttgcggaaacataaccgggaaatcaacagggttggttcccataatagcactgaatatatctcctactccatttccgtcctttgtagtcaaagggccatgcatgtcattcaactgcacattcagatgcagcgagatagtagaagactttgacagatgaaaatccacgttgttctgaaacgcatatttcatatagtctatattgtttttataagagaagaaatcactggaacgatccttcaacataccggtttcatggttcatattgacattcataaaataagtgattttagaagtacccccacgtacattaaaattcgccttttgattgaatgttgcatctttgaagacttctttataccagtctacattaggataaatataggggttcagattattgattgtaccgttaattctttcatcagaataaagtacggctcctgttccctgattggtaaccgcttcgttgtacaaacgcatatatgtaggtccgtcaacgatctccggtttcttgatcggagtattcacatatccttctatacgcacgccaatgatcggcctttcaagatcactacccgattttgttttaataataagtacaccgttggctccacgagtaccatacatcgccgatgccgtagcatccttcaatacagagaagctttctattacttcaggatccaacgagttcaggtctgctttggacacctcaactccgtctaaaataatcaaaggagaagtcgccccattcatcgtcgcaacaccacgaataaagaaatcggcagaattctgaccgggctcaccactacgctggtaagcaatcacacctgacaggcgtccggcaaatgaagaagaaagattggcggaaggcaccaaaaggtctgaaggacgtacggactgaatagacccggtgatagtctccttcttttgtcctgtaccaaacgctgtcaccaccacttcatccaactgctgggcatcttcggatagggtgaccgaaataaccttttggctgcctactttcactttcttggtaacatatcctatatatgaaatttgtatttcatttttaggagttgccgcaagttcaaacttaccatccacatcggtaataacgcctgtagtagtacccagtagctgtacagttgctccaatgataggttcaccggttttagaatctgttaccacaccgataattttggcttttttttgttgtgtgctttccgttttctctactttaagaataacctcattacctttaatgacataactgatattgctccctttaaatacttcgttcaggacgtcgttgatggaacctttacaatcgatactcttgagatttgtgtttttcaaatcattagcgttgtagaagaaagtatatgtactacttttctctataagccggatggcttgaggaatggtgagagactgacctttaaccacaatctgtccttgcgcagcaagtgcagacaacggataaagcagcagagccatgacgatgtatttaagacaccgcttctggcaagaaaataaaaacttgttcatgcttcaatttttagatttaacattgggttaataaatattagttgtaaataagaattccttcattcatttctttgctcctaagattcaggctaaaacagattttatcaataacgtcttccaaagattcatcatagcggatacttccggtgaaagcacaatttttattcactttgtcgctaatggtgatgtgagagccatacatttgattcataatacgggttaagtgttccaaattaaattgggtaaagttatagcgcccgttttgccattctatgttttctatccgcctcagctgagttcttgcactaacaggattatacactaattcctggagtggtttcattgctattttatcatgggtggattctatattaaattcaatgctcccattaaatagtgtaatttcattcgcattagggttattctgttttatcagaaagcaagttcctttcacttcgataaaagctttatcaatgtaaactctgaatttactacccgaattcttgcgaacttcaaaaagtgaattgcctttcagccatacatccctgcattctttaaagttttcggcaaaacgtatggagctccccggctgcatccatactttcgaactatccggcaatagatacattctgctttcttgtgccgtaaattcaatatatttctctatttgagttctacccgtattagagtacatccaaagtccacccacgatcagaacaagagctacagaagcagcgatataccatagttctaaaggaactaacgttattatacataaaaaaacaagcaattattattaccggataaaaacaacatatagcgctataaaacaacgaattaacgtcaataaaaactaagatatgtatgctatcgatattattagagaagatttttaattaaaaagttataattcgcatgtggtggtaagcaggtctgttgtgtatttagttttagataacacaaaatagatttaagaaatggataaaaacagcaaggaaatagatctgatcaaaaaactattatcagatcgattagacaaaaaaggacgtaaaaagctctatcattcgaatttgataaagaaacaaatgagaaaacaatggaatgaaaacaaaaataatccggtagatacagagattggaaatcagatatggaataagatcgagaacagatgcaaaaaagttcacaaaagaatagttcctttagaacttatccaatcaatatatgttgctattattttatttatataataagtggatacattattctattaagcccatataataagacaatacagccatcataacataatatcaattaaacaaaatatgttattttttaatattcttgtagaaactgcatctatttagaacaaaaagattacttttgcacctctaattactaaaacagatgcaagagaaagaaacagtcaggaaattaaagcatggcgatcaggaagcatttgcttttttatacaatcattactggaaacaggtctataatttcacaaagctttatttcaccgcttcaatggacattgaggagattgtgcaggaagtatttgtgaaagtatgggaatctcaccattttttaaatgaaaacaaaagttttgagggctatctctttatcataacccggaatgttatattcaatcattcacgcagatactataaagaaacagccctcaaaataactgcgatacaagcagtcgaggaatcttatgatatggaaggagaactggatgccgctgacttaaagaaatacatcgatgaacttgtcatgcaacttcctccccgccaacaagaagtattccgtatgagcagggagctgcacatgagcaacaaagaaatagcagaacatttttctattaccgaaaaagcaatagagcggcatattaacctggctctgagatttctaaaaaagaatcttaatctattcatgctgttcatgggagcgtgactaaaatcgggattccattattttatctgccacccgcctcccagtgccttatacacctgtaccacagcaatcagttcatcccgcatcgcattgctaagtccgatctgggcatcgaaatatccacgctgggcatcgagtacatcgagataattcgtcactccattgatatattgcaattgcgccagatctacgtaactcttagccgaacgttccaatttggcacgaagatcatatacttccttgattttattaaagttcacaatcgcgtttcgagtctctttgaaagcggtcaggacagacttttcgtagctgtgcacttcagcctcgtaagcagctttcttagctttgagggcagcacgatttttaccccagccaaaaattggtgtaagcaaagcaccctccattatactataaggcgacttcaacagctcggaaagtgcagtgctctccgatcctaccctgccggtaagtgaaatgcgtggaaacatatttgtataggccacccctacccgggcattggcggcaatcaatttctgttcagcctgacgaatgtcaggacggcgttcaagcagtcctgaaggcaaaccgacaggtaattcctgcggaaaattgaactcctgcaacaagcggctacgtgtaatcttattgggatactcaccggcaaggaaagctatatcattctctttcaacgagattttacgctccagatcgggtaccaacgtagcagtacgtgccaactctacctgcgactggcgataagaagtctcggaggtcaatcccccttcaaagcggatacgggcaaggcgcatcccctcttcacgtgccttcaacgtttgacggacaatgtccagttcggtatcaagagccaccagttcatagtacgcctgagccacttcagctacaatagtcatccgaagagcgcgttgtgcctcaacggactgaagatactcggcaatgctggcagaacgtgcccaacgaagatttccccagaggtcgagctcccaggagaaaagaagttgcgcctcgaaagtatctctacgtttgaaagcatctccaccatggttttcgttttcccgttcagcagtcaccgtacctttaatgtccggcaacagatttgctgtcgaaatacgtttttgagctgccatttccttgacacgggcagcggctatcaacatatctttattatgctccagtgcccggtctatcagactccggagggtactgtcagtataaatctgccaccattccctatctccgaagctcagggtatcctgatgctgtgccagactatcgggcaagttaaggtcgggacggacataactttttcctatcttgcaagaacccaaggtaaatgcagttagtaagagagtaatatataaatagcttcttttcataattcaatcaattttctttttagacttgaacggtaacttcacgttcacattcggcacatttctcagttttgcttttgttttatagaccagtacgaagaagaacggaacaaggataatgcccactacaatagcaaaaatcattccgaagaatactcccgtgccgatggccgcacggcttgccgaaccgggaccggttgccaacaccatcggaagtatacccagtacaaacgcgagcgaagtcatcaagatggggcggaaacgcaattgtgccgcatggatggctgattgcaccagatcacctccccggtccacctgcactttcgcaaactctacaatcaggatggcgttcttggccgccaatccgacaagcatcaccaatccgatctggaaatagacatcattttccagtccgcaaatccatacccccagataagcccccagagcggctaccggcagcgaaagcaatacggcaatgggcactgtccagctttcatactgtgcagccaggaagaggaatacaaaaaggaacactaatgccagtaccaatccggtctgcccacctgcctttttctcttgataagagagaccactccattccaagccaatattatcaggcagatggtcacgtgcaatctgctccataatctccatagcctgaccggaactatagccctgcgccgcctcaccacgaaaaacagcagtggtaaacatattaaaacgtttaatgctacccgggccggtggtatacgatgcgttacccagagaagtcagcgggatcatcgctccattagaggccttcacaaaaaacaggttgatattgtctttatgttccctatagggtgcttcagcctgaatgtataccttataaatacggttgaacatattgaagtcgttcacatagaccgatcccgtataggctttcatggttgagaaaacatccgccagaggcacaccaagcatcttcactttatcgcggtctacatcgaagtagagttgtgggatatccgactgaagtgaagaggaaagtcctgtcagttccttgcgttgggaagcgtaatacatcaaagtatccgccgcctgcaccaaattatcgaaagtagcttcaccacgcgcttcgagttgcatttcgaacccacccgaggttcccaaaccgggaatgacaggaggagtggagagataaaccttacattccggatactcactcagatcgcgacgaacgtttgtcataatctcgtctatcgaagtattcttgcggtcttcccacggcttcaaaattacggttaactcactccgtgcctggttgctgcccacacggggactgcttccggtcacattctgtacatacgctatatacggattcttttccagataagtgatggcacgatccgttacctcccgggtacgctccagcgtagccccttcgggcaactccaattctatcttgaaatagccttggtcttccaccggaaggaaacttgtcggaatcagacggtgaatcaacagaataccgatcagtactaccccgaaaccggccaatacacgacgcggattaccaattacccggcggatagcgactacatacttatgattgcccacgttcaaccagtggttgattttgcggaaaacaatgttcttctttttaccgttatccggtttcagaatcaacgaacacatgaccggactcagcgtcaacgccactacagtagaaatcagtacggatacagcaatggtaatagtgaactgacggtaaagctgccccgtaataccgctgaggaagctcaccggaacaaacaccgcacaaagcaccagagaagtggcaatcaacgcacccgccaatccgttcatggctttcttcgtagcttcgtacggtgaaagtttctcttcctccataatacgctccacgttttccaccacgacaatggcatcatccactacaataccgatagcaagaatcagccccaacaatgtcaatatattcagcgaaaagccaaagatcaacatgaaaccgaacgtaccgatcaatgaaataggaacggcaactatcgggatcaacgtagcccgccagctctgcaaagagagataaacgacgagcaccacaagaaccagcgcctcaaacagggttttgtatacttcatgaatggactcggaaatataagtcgtcatatcgaatggcacctcatagctcaacccctccgggaagttcttgctgatttcatccatcgcttccttgacactttttgcaacttccatcgcgttagcgcccggaagcatataaatgcccagaacggcagcattcttgccattgatcccactctccgtactgtatgaagaagcttcgagagaaacccgtgccacgtcacgcaaacggatgatagaaccattcgtattggcacggatcacaatgttctcaaattgctctacagtagaaaggcgtccttgtgtagtgataggaatcgttacatcgagtcccttcaccggctgctgaccaagtacacctgcagccgactcacggttctgatctttcagcgcattctgtaaatcctgtacagtcagtccgaagtttgccagtttatccggttccgcccatatctgcatggcatagtaacggctaccgatattcgaaacacgtcctactcccggaatacgacggattacatcgagtacattgatcgtggcaaagttactcaaataaatttcgtcgaacttcggatcagacgacatcagcgtaagggtcatcaactggctgggtgcctgcttctctacggagataccgttctgaataacttcagctggcaaacggctttccgccagtttcacacggttctggatttctacggccgccaaatccggatcggcagaaacatcaaaagtaaccgttgccgaaaatcctccggaattggaactgttcgactccatataaagcatacccggtgttccgttaatctcctgctcgataggagttgccactgcctgtgaaaccgtcaatgcgctggctcccggataagaagcactgatcttcactaccggaggagtgatctgaggatactggtcgacaggcaacatggtcagaccaatgatgccgataatgacaatcagtatcgagataacgatcgagaaaacaggtctatctataaaaaaactaactttcatattctataaggcctcaccccacccctctcccaacgagagggaggaagagtttcttttaaattatacgttcttatttatctcaggaaaggagtcattcgctctcctttttctcggttagtgactgaggtaaagtagccctcaccttcattcccggcgtcagtttgtgatatccttctattaccacttcttcgcctgcagccaatcctctctccactacaagtttattgccaaattcaggtcccagctctataaatcgtttctctaccgttgaatctctgcgcatggtatagatataggctccacccttctcgatagttaccgccttgtgcggcaccacaatcgctccttcgcgtacatccagcaacagctttacctttgtgaactgtcccggaagcaacacctgcttcggattcggcatctctgcccggactgaaaaagtacctgtctggggatctacctgaggttcggcaaaatccacatatcccttgtaaggatacaccgtattgtccgccaatgtaatagtgatgttcggctgccaggaacgagaagggtcctgttgcccgatattaatattgcgttctttgctcttcaaataatccagagcagtcatactgaaatctaccagtacagtgtcacttttcacaactgtagccaacagcgatttaccacccggtcccaccagagttcccaagtccacgttacgctcactgatatgacccgacagcggagaacgaaccaatgtataacccagttccaactcggcctgtgccagatctgcctcgctcatagcgacggtcgccaccgcactttcataagctgcctccgcattatccagatccaactgactggccgcattttgcgcatacaacggcttgatacgttccaaatcccgttttgccttcaatgcttgtgcttcatcttttttcaattgtgcccgtgccttatctgctttggcacgatactgatcctgattgatcacaaacagcacctgatttttattcacatacgttccttcggcaaaaagcatactttccagatatccttccacccgcgcccgaacttcgacaaactgttgtgcacgtatacgccccacatactctccgaaaatctctacattgtccctttctgccggttctacaatcacagtaggtatctccggctttgctttatgtggccgcgtcagaacccagtaaatgcctaccaccaaagccaaacagacgatgcccactattgttctttttctccttagtttcagctcttttctcgttaaaaatagtctcatgcttgtttgtattattaaaattaacttatcctttcttagctactttacaaatcagataccaaactatgtcccgaatatatctttttaactaaaaagctctctccaatgccctgaagaagctgttttagtgatcttccgaacataactgccgtttatccaaagtgtggaattgtgtccctgattggggaattattccacaaaagggtcacaaagataattcttttctgcataagttccataacttgcacttttagtgtcattcactacttacttaccaaataataatataaatttgtagtgcattcataaaaataacactataatgaaaaaacatttgtcactgatattagttctgttaccggctttttttctggcattgcccgctatggcacagcaacgtaaaaaagtcggagtggtactcagcggaggaggtgcgaaaggggtagcacatatccaggctctgaaagtcattgaagaagccggcatcccaatcgattatatagtaggcaccagtatgggatccataatcggtggattatactccatcggatatactccgcatcaactggacagtatggtacgcaaacaagactggatgtttttactcagtgatcgtgtaaagcgtagtgccatgtcactcaacgaacgcgaaaaatcagaaaaatatgtcttttcattcccctttaccaaaagccccaaagacgccgtttccggtggaatcataaagggacagaatctggccaacctatttacggaactgacagtaggctatcatgattccgttgatttcaacaaactgcctatcccctttgcgtgcgtatcacaaaacatcgtaaatggcgaacagattgtattctacaatggagtgcttgccacagcaatgcgagccagcatggcgattcccggagtgttcacacctgtgcgcaaggatagcatgattctgattgacggcggcatgattaacaattatcccgtagatgtagccaaatcgatgggcgccgatgttatcatcggtgtagatgtgcaaaacaacttgaaagggatcgacaaacttaacagtgctccggacatactctcccaaatcattgacctgacgaccaaaaacaatcatcaaaaaaatatcagcctgaccgatacctatataaaggtgaacgttgagggatattcttcggccagttttaccccttcggccattgattctctgatgcaccgaggagaagaggcagctcgtaagcaatggaactccctgctcgctcttaaaaagaaaatcggtattgcagacactttcaaacccgagtcacatggtccttataccttattttcaagcacccggactttgccagtgaaggaaattactttctctgatgtagaagaaaacgacaagaagtggttaatgaaaaaatgcaaactgcaagaaaacagtgaaatcagcatgcgacagattgaacaagcactattcattctgcgcgggaaccaatcttactcaaacgccagttacacgttaaccaatacccctgaaggctataatttaaccttcctgttagagaaaaagtatgagaaaactatcaatgtaggtctccgcttcgactcggaagagatagcttcgctattgataaatgccacagcacaattaaagacccacattccttccaaagtttctgttaccggacgactgggcaaacgatacatggcccgggtagattataccctggaacccatgcaacaaagaaacatcaatttctcgtacatgttccagtacaatgacatcaacatttatgatcatggcgaccgtgcctacaacacaacttataaatatcatctaggtgaattcggattttcggatgtgtggtataaaaatctccggtttggattcggcgcacgaatcgagtatttcaaatacaaagatttccttttcaagaaaccggaatttacaatggatgtcaactccgaatacttcatcagttattttgcgcagttacgttacaacaccttcgacaaaggatacttcccatccaaaggcagcaacttctccggtgcttattcattgtatacggacaacttcgcccgatataacggacatgcccccttctccgcactcagtgcctcctgggaaagtgtgttctctgtcagcaaccgtctggccctgatcccggctatttacggcagagtactgatcgggcaggaaattccttatgcctacgagaatgcgttgggaagtgacgtgttcggacgttatttgccccagcaactcccgttcgccggaatttacaatatagaattaacgcacaattccgttgccgtggcttctctaaagctgcgccaacgcatggggagcaaacattatataacgttagccggaaactttgccttgagtgacgataattttttcaagatcctgaagggcaaccggatttacggttgtagcatcggatatggcttggacagcatgttcggtccattagaagcatcattggggtactccaaccaatccaaagacgtaggattttacgtaaacctgggattttctttctgacaataccaacctctttcttccggcagggggtgtagccccacgaggtaaagggtgtagccctcccgccaatagggtgtagccccggcatacggatggctacaccctctgctaaaatgcgcctgtaaccaccaaacaacaagacagacatagcacggaattatttaattatttcaaatttattactcagaaccgaagaaagtcgttatctttaccgaaaatattttctatatactcacataaaacatttagaattatggcaaagagaagagaacttaaaaagaacgtaaactatatcgcaggtgaattattttcagagtgtttgatcaacagcatgttcgtaccgggtacagataaagcaaaagctgacgaactgatggcggaaatcctgaaaatgcaggatgaatttatcagccgtatcagccacaccgaaccgggaaatgtgaaaggattctacaaaaaattccgtgtagacttcaatgcaaaagtaaacgaaatcattgacgccatcgcgaaactgaactaagaatgaaaaaagcaatatatagctttatttactatcgcctgctgggatggaagatgaacgtgacagtacccaaatatgataaatgtgtagtttgcgcagctccccataccactaatttagatttgtttattggtaaactattttacggtgccatgggaggaaagaccagtttcatgatgaaaaaagaatggttcttttttcctttagggctgcttttcagagctgtaggaggtattcctgtagatcgtagtcgcaagacctcattggtagagcaaatggttcatcacttcaataccagcaaaaagtttcacctcgctattactcccgaaggaacgcgtaaacgcaaccccaactggaaaaaaggtttctattacattgcgctcaaagcacaggtacccattgtcctggtcggcatcgactatacaaccaagaccattacgtcgactaaagcagtcatgccaagtggagatattgacaaggacatgcgtgaaataaaactttatttcaaaaatttcaaagggaaacaccccgaaaacttctccattggagacgttgaatgatttatgaaaatctcgattgtacaaacagatattatctgggaaaataaacaggaaaatctccgtttgctccgcgaaaagctacttcctcttcgcggaacaacggagattgttgttttaccggagatgttcacaacgggattcagcatgaacagccgaacattggccgaaccgatttccggtttcaccatccggaccctcaaagggtatgtcgcagagtttcagttcgcattggtcggaagtttcatctgcgaagaagcaggtgcttattataaccgggcctttctgattactccggacggtcaggatttttactatgacaaacgccatctcttccgcatgggatgcgaaactgaacacttttcggcaggcaaccggagggtgatcgtcccctatcggggctggaatatctgccttcaggtctgttatgatcttcgctttcctgtctggagccggaatataaacaacgaatacgaccttcttatttacatagccaattggcctactccacgcatccatgcatggaatacactactttgcgcacgcgctatcgaaaaccaatgttacgtatgcggtgtgaaccgtacaggacgagacggcaacggacttcactatccgggatattcagccttgtatagtcctaaaggcgagatcctgacagggactcccgactcagaagaaaagatacaaaccatcgaacttgatatagaaactctcactgcctttcgccataaattccccagctggaaagacgcagactcttttctcctttattaaatctacaggacataatttccgcatttaataaaaatatctcttgaattatagtatataaatgcaaaaaagtatctaattttgccagacaatcaatttattgtaccaaaaaacaaaccctaatttaactcataacacgaatgttaacccaattaattaacgcacgtatactcaccccccaaggatggatgaaagacggttccgtgcttatcagagacaataagattttagaagtcacaaactgcgatctggccgttatcggagctgaacttattgacgtcaaaggtatgtatgtagttcccggtggggtagaaatccacgtgcatggtggtggaggccgcgactttatggaatgtacggaagatgccttccgggcagcggtccatactcacatgaaacatggcactacaagtatctttcctacactttcatcatctacagtccccatgatccagcaagctgctgaaacctgcaccaaactgatggaagagaaaaacagccctattctgggactgcaccttgaaggtcattacctgaacatgaaaatggcaggaggacaaattcccgagaacatcaagaaccctgatccgaatgaatatattccgatcgtagaacagtatcattgcatcaagcgctgggacgccgctccggaacttccgggagctatgcagttcggaaaatatattgctgccaaaggtattctcccttccgtggcacatacacaagccgaatttgaagacatccgtacggcatatgaagccggatatacccatgccacccacttctacaatgcaatgcccggtttccacaagcgcagagaatacaagtatgaaggtacagtcgaaagtatttatctgttggatgatatgaccgtagaagtagtagccgatggaatccatgtacctcctactatcctgagacttgtatataaaataaaaggtgtagaaagaacctgcctgattacagatgcccttgcttgcgccgacagtgacagcaaagaagctttcgacccgcgtgttattatcgaagacggagtatgtaagttggccgaccattctgctttggcaggaagtattgccacaatggaccgcctgattcgtaccgtcgtacagaaagcagaaattccattggaagacgcagtccgtatggcttccgaaaccccggcacgtatcatgggtgtatacgaccgtaagggttccttgcaaaaaggcaaagatgccgatatcctggtactcgatgaggacctcaacgtaagagccgtatgggccatgggtaagctggtgcctgaaaccaatacgctgttttaatcgaatagacgttttttgaacataaacggtgaacaatgaacagaccattataacgcagcctgttcattgtccaccgtttatcgtttaaccttcatcgttttatcactcccctcctccccatttataggtaaaaaaagattttaatttaaattccctgtcaaccttatcgcatagttgattgtttttatatatatttgttcagagtttccgataacgacaaagactcagtcaaacttaattaataacaaacttatgaagacaaatcttagttctcagattacactcaacagggtctcccccaggtattatagaccggagaatgcattcgagagatcggtattaacccgattagagaaaattcctacagatatttatgagtctgtggaagaaggtgcaaatcatatcgcttgcgaaatagcacaggtcattcgcgataaacaaaaagcaggacgtttctgcgtactggcattgccgggtggaaattcaccacgcagcgtatacaccgaattgattcgcatgcacaaagaagagggactcagtttccgtaatgtaatcgtattcaatatgtacgaatactatccattgtcccaagacgctatcaacagcaatttcaacgcattgaaagagatgttcctcgatcacgttgatattgacaagcagaatatcttcactccggatggtacgatcgctaaagataccatctttgaatactgccgcctgtacgaacagcgcatcgagagtttcggcggtatcgatatcgccttactgggcatcggccgcgtaggtaatatcgctttcaacgaaccaggttcacgcctgaattctaccacccgattgattttgctggacagcggttcacgcaatgaagcatccaaaatattcggaaccattgataatacgccaatcagttccattacaatgggtgtggccactattttggcagcaaagaaaatctatctgctggcatggggtgaagaaaaggcgcacatggtgaaagagtgtgtggaaggtaatgtaacagataccattccggcatcttatttacagactcacaacaatgcacatgtagccatcgacttgtcggcagcttccaacctgacacgtattcagcgtccatggctggtcacctcttgcgaatggaacgataaactgatccgcagtgctattgtatggttgtgccagttgaccggaaaaccaatcctgaaactgaccaacaaagactataacgaaaacggactgagcgaactgcttgccctattcggatctgcttataacgtaaatatcaagatattcaacgatctgcagcacaccatcaccggatggccgggtggcaaaccgaaggcagacgacacctatcgtcccgaacgtgccaaaccgtatccgaaacgggttgtcgtattttctccacaccccgatgatgacgtgatctccatgggaggtacgattcgccgtctggtagaacagaagcatgaagtccatgtagcatatcagacttccggaaacattgccgtaggtgatgaggaagtagttcgtttcatgcatttcatcaacggattcaaccaaatctttataaacagtgaagatcaggtgatcagtgaaaaatatgccgaaatccgtaaattcctgaaggataagaaagacggtgatatggatacacgcgatatcctgaccatcaaaggcttgattcgccgtggtgaagcacgtacagcttgtacctataataatatcccactggaacgttgtcacttcctggatctgcctttctatgaaaccggtaaaatccagaaaaatccgatcagcgaggctgacgtagaaatcgtccgcaatctgctccgtgaagtgaaacctcaccagatttttgtagccggtgacctcgctgacccgcacggcacacaccgtgtgtgtacagatgccgtatttgctgctgtagaccttgaaaaagaagaaggagccgaatggttgaaagattgccgtatctggatgtatcgtggtgcatgggccgaatgggaaatcgaaaacatcgaaatggctgtgcctatcagtccggaagaattgcgtgcaaaacgtaactccatcctgaagcaccagtcccagatggaaagtgctccgttcctgggtaatgacgaacgcctgttctggcaacgtagcgaagaccgcaaccggggtaccgcagctctttacgacagcttgggattggcctcttacgaagcaatggaagcatttgtggaatacattccactataatcagagcttattagtgaaataaaaataaagaagagtgaggagtttgagactcttcactcttcttttctttaataaaaagacaaatcatacatgaaacaagaagaatatctccgtcttctccctgtcgagggagcatataatatgcgcgacttgggaggttaccccgcagcaggccataaacacgtaaagtggaaaacatttatccgttcgggcgatctcaataaactgacagaatccgacctggcctatcttgcctctttatccatccgtacggatattgacttcagaagtatacaggaaaagaaagtggcagcagacagaataccggcaacggtaacgcaatacattcctctgtccatcgaagccggtgacatgaccgacatggctcacttcaacctgaacaacattccgaaaatacttgaacaggcatacgtctatatcatccaaaatgcccaggatacttaccgggagtttttccggattgtttcggaagaacggaacactcctcttttatttcactgttcggccggaaaagaccgtaccggtattgccgccgcattattattgggagcattgggtgtagacagaaaagtgattatggaagattatatgctgtctgccgaatacctaaaaggcaaatacgatgcgatcgtacaggcccatcccgaattcgcacctcttaccaccgtgcgtaaggaatatctggaagcagccttccagactattgattccgattaccaaggtctggagaacttcctgagaaatcaattaggagcagatatcgacagactaagggcattgtataccgaataaacggttcattaccagtctgaattgctaatgacttatcggaatcaccggtttttcatttatttcttctatttttgtacccggactattactcaaccgaatatatgaaaaaactatgtatactcctcctgttgctccttacgggcacaggtatcttatttgcgcaagaaattgaaaagagcgtaaaagaacggcttagcaattactttgagacttacatcccggcatctgccaataccggaagtagtaagttaaaaagcgtagatattgactttgaaggtaaaaaactatccatctatgcttccgaaagttttgcttatcagccctttctatcggaaacagtagatgaaatctaccatcagatagcagagttacttccgggccccgtacgctttttccgaaccacggtttatgtcaacgaccagcccatcgaaaagttagttcccaacttctttcgtggaaaaaagaaagataagtcgcgactctcgaatgcggaatacagaggagcaccttgggtaaaaaatgtttcccgcccctatgaagtaaccaaaggactgcaaaactgtcacatctccctctggcaaagccatggcaaatatttcaaaaacgataaaggcgaatggagttggcaacgtccgcgactgttctgtaccacagaagacttattcacgcaatctttcatcctgccttatgtcattcccatgcttgaaaacgccggagctaatgtttatactccgcgtgaacgggatactcagaaaaatgaagtgattgtagacaatgacacccgaaacggttccatctatctggaaatgaaaagccgcaaggcccgttggaatcaaacaaacggttatggattcgcacaaagaaaatctgtctacaaagatggagaaaatcccttcctgacaggtaccgcacgcttcacccgtacagaaaagaaaaagaataaggcattcgccgaatggatccctaccattcccgaagcgggaaactatgcggtatatgtatcttaccagacactccccaatagcgttagtgacgccaagtatctggtatttcacaaaggtggtgtaacggaattcaaagtcaaccagaagataggcagtggcacatgggtataccttggtacatttgagtttgacaaaggcagcaatgattacggcatggtggtactgagcaatgaaagcaatgaaagcggagttgtctgtgccgacgccgtacgtttcggcggaggaatgggaaacattgtccggggtactacagtgagcggattaccccgctatctggagggtgcgcgttattccgcccaatgggtaggaatgccttatgacgtttacggaggaaaacagggagaaaacgattatgcagacgacatcaatgcacgctccaacaccatcaattatttgtcggggggctccgtattcaatcccgtacagaaaggattgggtgtaccgttagaaatgaatgtggcactgcacagtgatgccgggtacagtaaaacggacgatatagtagggtcactcggcatctatacaaccaacttcaataacggactgctcaactcgggaaataaccgatatgcttcgcgggatctggccgacctcatgcttacccaaatacaaaaggatattcgtgccaactttaatatacaatggacccgacgcagcatgtgggaccgtaattacagcgagacccgcctgcctgccaccccatccaccatcatcgagttactgtcgcaccagaactttgccgacatgaaactcggacacgatccgaatttcaagtttaccgtaggacgcgccatttataaagccgtactgcaatttgtcagcagccagcacaacaaagagtatgtggtacaaccacttcccgtaagcaactttgccatcggattcggtaaaaagaaaaatactctggaactttcatggcagggagagaacgatccatcggaacccactgcccgtcctcgtgagtatatagtatacacccgcatcggatatggtggtttcgacaacggggtacgtgtggacaagccttcgtactctctaaaaatagaaccgggtctggtttattcatttaaggttacggctgtcaaccggggaggagaaagtttcccgtctgaaattctggcggcctacaaagccaagcgagaacacggaaaagtgcttatcattaacggtttcaatcggttaagcggaccggcagttattgacacaccggatgaagcaggctttgatctggaacaagatcccggtgtcgcctaccaatataatatttcgttttgcggagcacaaacagactttgatcgctttcaagccggaaaagaaggaaaaggaagcctgggttatagcggcggcgaactggaaggaatgaaaatttccgggaataccttcgactatccatttatacatggcaaagcgattcaggctgccggaaactacagcttcgtttcatgcagtgacgaagccgttgaaaacagacgtgtccaactggagcactatccgatcgtagatttcattctgggcctggagaaagatgatatccaaagtgatccggcccgcaaaacgtattataaaacattctcttcacctatgcagcgcttactgacagcttattgccagtcaggaggaaacctgcttgtcagcggatcctatataggcagcgacatgagtaattcgcaaggtaaccgcgaattcacagagactgtactgaaatacggctatcagagttcattaagtgatacccgttccggacagatctcgggcctgggacgtaccatacagattccccgcttgcctaacgaaaagtcttatgcggtaactgctcccgactgcattgtgccggtaggttctgctttcccggtattcgcatatcaacccgggcaacgcagtgccggaattgcctataaaggagattatcgggtattcgcaatgggattcccattcgaaagcatcgaaagcgaaacggaccgtgccacagtaatggcagcaatactaaaattcttcggagaaaaataaactttcaataaacattgttatgtcccggtatttggtattagtcttttgtctgcaaagaacaagttctttgcagacaaaactgtcataatgtctgttatttacgtgaatttattttaaggtttgctgccatctgacataatggctgctatcgttcttgttcctgccatcattcggttgccccattaccattactgtttttgccatcttatctttttctaatttcataatagagtcttctaatctgattatttatggttggataatcatttgtggcattttagatgaaccaatttttataattatgaaaacaaaaatgttttttttagtagtagtcatgctactttgtagaggcgtagcttatgcatacagcccttccgtgaacgttccgatttcaaaggtggaaggaatcgaacaagatattccacctcctcatgttacacctcccccactgccgagtcaggtctttcttcatgtgggcgaaatagcagaaattccatatcccatgtttggagcaatgatatgggaatgcgataacccgccggaaggcatagaacaagaagagtcatacgtacttggcactatgattattctgcgcataagaggaattttggcaggaagatatcatgttaatatgaaatggtataatccgctcaatccggggcagcccccattaggacggcaaaccattcagattattgttcagccatggccttgacaattgacagataaacagtcataaggttccctccgtgagcatgtctgctcacggagggaattctatgaaaatatgaattcatcaaaaaaaatccctgctgcatactccattcttcattttaaattctatctttgctcctaataataactattaaaataaaagcactatgtacacaatacaagcaaatccgagcggtacacgcagcatggaaatatctgaagagaatttggtaaccatcgaaaaacactctttattccagcatctgatagacagcaatggcattgtagatgaagccgttctggagaagttgaaactgaatatacgttcgctgatagcaagtcaggaagaagacagtaaggacctgctcgacctctgcatagacgtgatttatcacaataatatgaaagcattcgggttgcagcaactcatcaaactttatctcacctggctatcgaagcaggaagcagaagaagaggagaaagtatgattaccattgatacctgcggaatgacaaactatagcccgttgattccggccataaaagcgatgtgtaatgccagttccggtgacaaaatggagattgtaacggatcaggtagccgcatttcaggatcttaaggaatatttatcagaacaaggtatcggattccgcgaaatatatgatggagagcggatgactttacagtttactatcttatgagcgaagtacaaaatcaaataaagaaatggccggtaacggcaatcaaaaaaataaaaaatacattcggtagcgcagaaaaattctatgctaccgtttatcttattgcccgcaacgagcatcattgtcaaatgatgggagtagccggagccgaacagcgcttaaaaacgattcatgcctatcagggtatgatccgttttatgattgatgaagaaggacttaacggtaaggaagttcttgaagccatagccagcgactatctggaggatttcgtgaactatcgtgagcaagacttcggaatgaccaacgaggaattcattgctattattaaaagaatcggctgagcgcatggatatattcctaatcattttgggcagcatctgcctgcttgtcggattggccggatgtattgtccccatgttgccgggacctcctgttgcctatctggcattggtatttctacacttcaccgataaagtttccttcactattccgcaactgttcctttggctgttcattgtggtactgatacaaatactcgactatttcattccaatgtttggagtgaaaaggctcggaggtacttcatggggcaaatggggatgtatcatcggtacctttgccggtattttcctgtttcctccctggggggtattcatcggtccgtttgcaggcgcagtagcaggcgaattgctgggcggtaaagagaccaaatacgccctgaaagccggattcggagcatttgcaggtttcctgttgggtaccgtgctgaaggtagccgtatgtggttggttcatcttctgctttatccgtgccctcgtatagcaaaattatccgtatctttgctcccatgaaagaatatcgacttactgattggttacccaccactaagaaagaagtagagcttcgcggctgggacgaactggatgtcatcctttttagcggtgatgcttatgtagaccatccttccttcggagcggccgtcatcggccgtatccttgaagccgaaggtttacgggtggccatcgtacctcagcccaattggcgtgacgacttgcgcgatttccgcaaactgggacgcccccgcctttttttcggcatcagtgcaggttgcatggactccatggtgaacaaatatacagctaataaacgtttgcgcagcgatgacgcctacacaccggacggacgtccggatatgcgaccggaataccccacaatcgtgtacagtcagatcctgaaaaaactctatcccgatgtaccggtcattttaggaggtattgaagcaagtatgcgccgcctcagccattatgactattggcaagatcagcttaaaaaaagcatcctttgtgaaagcggtgccgacatgctgatttatggtatgggtgaaaagcccatttgcgaactggtccgcagattaacaacgcacaatgaataccgggacagtacgacttcaccgtttaacatctgtcgttcttcactgactactattccgcaaattgcttatctgaccgatgaatacgagcctgatgagcaagatattgccctccattcccacgaagaatgcctcgctgataaaaagaagcagtccgccaacttcaggcacattgaagaagaaagcaataaatatgcagcagcccggattgttcaagctgtagacaacaaagtagtagtggtaaacccaccctatccaccgatgacacaggaagaattggaccattcattcgatcttccttatacacgcttaccccatcccaaatacaagggaaaacgtattccggcttacgacatgattaaattctccatcaatatccatcggggatgttttggaggatgtgccttttgtacgatctccgcccaccagggaaaatttattgtgagccgaagcaaagagagcattctgaaagaggtaaaagaggtggtacaactacccgacttcaaaggaaatcttagcgatttaggaggaccttctgccaacatgtataaaatgggtggaaaagacctggcactttgcaaacgttgcaaacgtccttcgtgtatccatcccaaagtatgcccgaacctcaatacagatcatcggccattgctggatatctaccatgcagtagattctttaccggaaatcaaacagagctttatcggcagcggagtacgctatgatttactgcttcatcaaagcaaagacccttccgtcaataaaagtacggcggaatacacccgcgaactaatagcacgccacgtcagtggccgcttgaaagtagcaccggaacacaccagtgaccgggtactgagtatcatgcgtaaacctgccttcagccaattcggggagtttaaaaagatatttgacagaatcaaccgggaacttggcttacgccaacaattaatcccctatttcatctccagccatcccggatgtagagaagaggatatggcagagctggcagtaattaccaagcggcaggattttcatttggaacaggtgcaggacttcactcccacccctatgaccgtagctaccgaagcctggtacaccggcttccacccatacacactcgaaccggtattcagtgccaaaacccaacgggaaaaattggcccaaagacaattctttttttggtataaaccggaagaacgacggaacatcatcaatgaactgcgccgcatcggacgggcagacctgatagacaagttgtacggaaaaagataattcatgctttattcactccggagaacacagaggacacaaaagtttcgctgtttgaagataaaatttatcctctgtatatactctgtgtcctccgaggtgaactgtctattctttttctctcaccggcaatgccactatctcctgaagcacactgacggcggtttccacattcggaatgtctttcaccaacatagaccgacgtccgttctgctccctcaaatcgcatcggcgggtatatttcatcatataatcgatcatcttgccaaaagcggcactctgataatacgggctatccggattgctgacaaagaacagagtcatacgcccccctttcaggaatactttttccactcccaaacgtgcagccagacgccttagcggtacaatacgtaacaattcctccgtttcgggaggaacagggccaaaacgatcctccaaccgtaaacggaaagcatttacatctttatcaagagtcaatccgtccaattcacgatacagtaacatacgttcgctgctacctgtcacataattggccggtaacaacaattccagatcgctttccacctggcactcttctacaaactcttcaccacttatgatgccttccccctttaattcgtcggcatagagctctgcaaattcatctgttttcagttcatgtacagcctcggataatattttctggtaagtttcatagcccagatcagcaataaaaccactttgttcggctcccaacatatttcctgcaccacgaatatccagatcctgcatggcaatatgaatgccactccccaaatcactgaaattctcaatagcttgcagacgacgtttagcttcaggcgtcaacgacgataacgggggagccagtaaataacaaaaagcttttttattgctacgtcctacacgtccgcgcatctgatgcaagtcactcagaccaaagttctgagcctgattgataataatagtattggcattcggtatgtcgattccactctcaataatggtggtggcaatcaacacatcataatcataattgacaaaaccgaagataatctgctccaattccaccggctccatctgcccatgcccgatagcaatccggcaatctggaatacgacggagaatcatcgctttgagttccgggagattggctatacgattattgaccagaaaaacctgcccattgcggctcatttcaaaattaatggcatcggcaatcacctcttcactgaacgtatgcacttccgtctgtatcggatagcggttgggaggcggagtagaaatcacacttaaatcacgtgctcccatcaatgaaaactgcaacgtacgcggaatcggagttgccgtcatcgtcaatgtatccacattcactttcatctggcgcagtttctccttgaccgacacaccgaatttctgctcttcatcaatgatcaacaggccaaggtccttgaacttgacatctttacccagaatacggtgagtaccgatcagaatatttacatctccggtttccaatcctttgataactgcctttgcctgtgctgccgtacgggcacgactgagatattctacccgacagggaagccctttcagacggtcacggaaagtctggaagtgttggtatgccaataccgtagtaggcaccaggacggctacctgcttattgtccgctacagctttaaacgcggcacgtatggccacttccgtcttgccgaaccccacatctccgcacaccaaccggtccatcggcatatcccgttccatgtcctgtttcacatctgccgtagctttactctgatcgggggtatcttcataaatgaacgaagcttccagctcccgttgcaaaaagctgtcgggactgtatgcaaaccccttctcctcacgacgttgtgagtaaagtttaatcagatcacgggctatatctttaatctttgtcttggtacgctccttcaacttctcccaggcaccggtgcccaacttgttcaaccggggagcttctccttctttccctttatattttgagactttatgcaacgagtggatggagacaaataccacatcttcattctggtaaaccagtttcatcacttcctgcgtcgtatctccgttaggaatacgcaccagaccggaaaaacgtcctactccatgatcggtatgcaccacataatcgccgggagtaaactgattcagttctttcagtgaaagagcaacttttcccgaacgggctttatcactcttcaagttatatttatgaaaacggtcgaacaattgatgatctgtaaacaggcaaagtttcagagtgtcatccgcaaacccctcatgcagtgtccgttccacagctgtaaactgaatccggtctccacggtcctcaaaaatagccctgatacggtctgtctgtttcgtactgtcactacagatataaagtgtgtatccccggctcagataatctttgaaagactctgccaccaaatcgaaattcttatggaaaatgggctgtgccgtagtatggaaagtcaacgtagcatccggtgtaccggttggcttgttgccaaactccatccgccggaaatctaaggcacggacagtaaattcactaccatcaatcagtttgccttccagagtgatgcctccgttctcttccgcctcttgtgcagcaagagcctgtggtgtaagcgattcatcgtgaacagcctgaatgcgttcccgcaaccagagaaaatcacgcattgccagagtcgtgtctttcggaataaagtcaaggaaagaagtagtaacttttccggttacggcaaggtcgggtacaatgacaatgctttcctttttctctttcgatagctgtgactctacctcaaaagtacggatactctccacatcatcaccaaaaaaatcgatacgatagggatactcggacgaaaaagaaaatacgtcaataatactgccgcgaacagcatactgtcccggttcatacacatagtcgacatactcaaacccgtaactatgtaatacatccgtgataaaaccggtgtccaccttctcgcccacatgtaacttcaatgtgttttcactcaattcctggcgcgagactaccttttcggccaacgcatccggataagtgacgatgcacaacccttgctcacctttctgaagccggctgagtacctcggtacgcaatatctcgttggccgcatctttttgtccatacttcaccgaacggcgaaacgaagaaggaaaaaacaaaatctgctccgtacccaatacctgagtaagatcatgataaaaataaccggcttcttccagatcacccaatatgaaaacaaacgggcaaggactcttctctaccagtgccgaagcgaataaggaagcagcggaagcatacaggccaccgcaatagatatgtctgactgcgggctctcccaacagtttgttcaaggcttccacattcgggtgcccggcatattgatgttgcagttcagtaatcgtcataaatagcattttagtccatcacaaacgcaccaactcacacagatcgctcaaaatcaatttccaatctgtgtgaatccatgtaacccgtgatgcaaattcaccgcaaaagtactaaattatccttagttttaatgcgctatctttggttagtagcggaaaagcgttacatttgtcttcaaatttagacacaatatgcagacatcggacagcatcgtaatcatccctacctacaacgaacgggaaaacatagagaacattatccgtgccgttttcggactggaaaagatttttcatattctcatcatagaagatggctctccggatggaaccgccaccatcgtaaaaaccttgcagcaagagttccccgaccgtctctttatgatagaacgcaaaggaaaactgggattgggaacggcatatatcaccgggttcaagtgggcactggaacattcatacgaatacatttttgagatggacgccgatttcagccacaaccccaatgacttgccacggctctacgatgcttgtgccaaccaaggaggagatgtagccatcggttcccgctacgtaagcggagtgaacgtagtgaattggccgatgggacgcgtcctcatgtcttattttgcatctaaatatgttcgcatcgttaccggactaccgatacacgacactactgccggttttaagtgttatcgtcgtcaggtactcgagaccattgatcttgaccacatccgtttcaagggttacgcttttcagatagaaatgaaattcaccgcttacaaatgcgggttcaagattatcgaagtaccggtgatcttcattaaccgtgaactgggcacatcaaaaatgaatagcagtattttcggagaagcggtatttggagttatcaaactgaaagtgaacagctggttccacaaatttccgcagaaaacaaaatgaattaagatatgaaaagaacattaatacaaaacgccatcatagtaaacgaaggacgctccacacgcggttcgatagtcatcgaaggtgaaaaaatagccgagatactggagaaaggacagaaaccggccactccctgtgaagagacaatccatgccaacggatgctatctgcttccgggtgtcatcgacgatcatgtgcattttcgcgatccgggcctaacccataaggccgacatatctaccgaaagccgggctgcagcagcaggaggggtaacctctattatggacatgcccaataccaatccgcaaaccaccacactggacgcactcaatgccaagttcgatttgcttgccgagaaatgcagtgtcaactattcatgctatttcggagcaacaaacaataactataccgagtttgacaaactggataaaagccgtgtatgcggaatcaagctctttatgggatcgagtacaggcaatatgctggtagacaagatgaacagcttgctgaacatcttcaatggaaccgatctgctgattgccgcccactgtgagaatcatgaaacaattaaaaagaatacggaaaaatacgtaagagaatatattgaaaaatatccttatcagtactaccatgttcaccacgaaacccttccgatgggttaccatgcaaagatacgttcgatagcagcctgctacgagtcgtccgaactggctgtacgcctggcacgcattgcagacgctcgtctgcatatcctgcatatctccacagccaaagagctttctctttttgataatgatattccattggaagaaaaaaggattacggcagaagcttgtgtttcgcacctgttattcgactcttcagattatgcggaattaggtacacgtatcaaatgtaacccttccatcaaagctaaaaccaaccgggatgcacttcgtcaggctgtcaactccaacctgatagacgtaattgccaccgatcatgcaccacacctgctcagtgaaaaagaaggaggcccgttaaaggcaatgtcaggcatgcctatgatccagttctctctgatcagtatgcttgaactggtgaacgaaggtatcttcacgattgaaaaagtcgttgagaaaatgtgccatgcacccgctcagatatataatatccataaccgcggtttcattcgtcccggttatcaggcagacctggtactggttcggccagacgcattatggacggtaagtgcagaacaaatcttaagcaaatgtggatggagtccgctcgaaggacgtacctttgactggaaagtagaaaagacatttgccaacggacacctattgtatactgacggacaggtagatgaagcttatcgcggacaagaaatctattttaaacgatgaacaatttctgaacgatcaaccatccaatgataaacaaggagcaggggataaaccgggaacgataaatgcagaagaatgggaaatatattgaaagataaaagcagggccttcgcgatacgaatcgtaaacctacataagtctctgaatgaaagaattgttatttaaaaccgaatatttatctgaaacagaatattcaagcatgtttgccaacgcaaacggatcaatgaaacttattatcaccagcattaaaacagtcaaatatggaaaagcataacccgtcatcatcccccgttcatcgttcagaaacagttgatcgttcagcgtttgaaaaccgtttatcgttcagtgtccatgatttatccccctacatcaactggatttatttttttcacgcctgggggtttcagccgcgttatgctgccatagccaatatccacggatgtgacgcctgtcgtgcttcctggctgacaacctttccggaagaagaacggggcaaagcttccgaagccatgcaactctataaagaagccaaccggatgctggacgaattggacagggactttgaagtgaaaagcgtttttaaactttgcccggccaatgccgacggagacaacctgattatcgacggtatcactttcccactgctccggcagcaagtcaagaaaaaagagaacgaacctttcttatgcctcagcgactttgtacgccctctgtcttcgggaatcactgatacagtaggagtttttgcctcttccattgatgcggatatggagggactttacgaacaagacccttataaacatcttctggtacaaacactctccgaccgtctggccgaagctgccaccgaaaagatgcacgaatatgtccgcaaagaagtatgggggtatgcaaaagacgaaaatctctctattcccgatcttcttgtcgaaaaataccagggtatccgccctgctgtaggctacccatctttacccgatcagtctgtgaactttattctcgacgaaattcttgatatgaaacagatcggtatccgcctgacagagaacggagccatgtatcctcacgcttcagtatgcggattgatgtttgcacatccggcttctcactatttctcggtggggaagatcggtgaagaccaattggcggattatgccgcgcgaagaggaaaaagcgttggagagatgcgtaaatttctggcagcaaacttgcagtaaatcttttctttcgatatatttgtaactgatcctatactttaaaatagaaaaagttatgaaaaaggttcttattctgttattatggttacttccctcctgtagcgtagtgatccttgcacagactcagcggatagcgggtactgttgtagttggtgacggccaacccgccgtcggtgccgccattgttgtcaaaggcactaatattggtgccgtaaccaacgtggatggcaagtttataatagcagaagcacctgcttcagcacagcagcttgttgtctatcacgtaggcatggaacgcaaagagatagccgtagctcccaacgtctatattcagctccagcccgtagagaaaggtttttcatggaatgtgaaagcgggagtcagcctgttcagtttccgccgcccggacggcttggacgaacgcaccggattcagtgccggtgtcggtgcggaatataatttcagcaggcattgggctattcaatcgggactgatggtcaccagcaaaggagcaactgccgagtacgacgggtattctccgctgtcctcgtctaccgaacctatctcttataaagccaaaatagctcctatttatctggacatccctattctggcagcttttaagatggatgtgtcaaaccatgttaagtttgtaatcaatatcggaccttatttagccgtaggcatgggtggaaagtatgaactgacaaacaaaggcggccataaaggtgaatcgcataaccctttcaaatcctactcttccttagctgaagcgaaaaataaagatgccttgttgaaacgtttcgacatcggggttcagggaggcatcggttttgaaatatggaaacattacctggtcaatgcctctttccagcacggattcatggagccggttaaaggaggaacactgtacgcaggcgataccgagaaacattacccgatcggagggattctgacagtaggatacagattttaaatacaatacgttatcaccacagatttcacagattatcacagatcataattgccaatagtctgtgaaaatccgtgtaatctgtggtgaacttagaaacgatatcctatttcaaaagcgacatccagaaaaccttccgagtgattccatgaagtacaccccactcttccggttcctcctatcaggaagtgcccgtattccactccgattccataggcaaatcctccggtaaaccgtttgccgaacaatgactggctttcagtaacatattccactctattataatttccactactatcataagaacgcttgcgaaattctttcttaacgtctccactgatccccaagtcaatataaggaccgaaactgaataccagattcagatcatttcctattctatacttcagtgcaaacagtaaaggaatctccagatagaacggattgtaagtaccactcacctgatcataagaaacggatgaagagccatcaccgttattttccgtataataatcatagaaatcataccctttcattttacgggaaaccaacaaaagtgagggttggaaagcccagtgtttcgacatccggatatcggcccctacccctccatagatactaagaccgtctttcagtttcgattcgggtccttgcataaacttacctgctccaattccggccttcacgatcaacgagaagcgttgcatcacttgtgtacgcatttgtatacgcatcgggagatctacatatccgctgcgtttaccttttgtcacctgtagtgagtcgaaatagacaggtacttcctccagtacaaaaactccatttttatcggtgacagcctgttggttcgtacgtttcaaggtaactaccgccccgtctaccggatagtaatcttcatccacgatcttctctaccactttttgtttttgggccataacgtctgtcagtgccaggcagaccaatgccaatgctatatatcttttcatatctttttattttttacattcaacatccgattattcatatccgcttgatcagaaacggtaagtaactcccaaagtaagtgccaggttgtgttctttcgcttccaaaccttcatcatcctgtcccaaacacatactctttccggaaacacctaccaaccacttcttgtattccacacctatgccataggcaacaccaaagctgaaaggatgcaataaagaatgtttcccaccataataatcatattcatactctttgctataaatgtcatactcttcatcgggtttacctgtttccgtagctttcacttttcctgcaaagccatacgaaaacacaggtcccacagaaaaggccagattcattttacgggctacgggatgacgaagaatgaacaacatcggcagatccaatgaaaccggattccaagtttcctgatacttcacaccgtttctttcggcattgaactctgctccacgattacatatttgtagagtaggctggaaagcccatcgttttgacatgcgtacttcaatacccaaaccaaactcatatcctaccttaaaatcggaaccatatgtagtatatttactcatgcttatcccggcatgtgccacaaacgaaagcttcttacgctttccggtgagctgtaccggtacattcaggtccacttcccgggtctccataccgatggaagtaacaatcacctttttgaccgaaagaggaacttcctgcaagaagaacttaccgtcgacatcggttatcgtgctgatattggttcctttggctgtgaccaatgctcccacaataggttgctgtcgtctatcgaatactactccttttacgtcgtgtgtctgaacctgagccattacggtgattgcgcaaatacaggcaatcattcctattattattcttttcatctgtttttcgttctttaaatccattttcttattctacgggaatcttaacggtctggtaaccactgtaagtaacccctacttcattttccgcataaacacggaaagcataaagtattcccggacgcaatccggtaatgactttactaagctgttgcccgcgattatactcaagaggaacctctatcttctgttcatccgtcaccgttcccgtttctggagaataaatgccatagctgtatccgtagtgcgtaatctgatagttatctatatagaaagtggcatacaggtttaccgacctatcagtatctatatacatcgtaaaataatcaataatcggttccgtaccctgttcggttgtaaactcaactaccggtccgtagcctgtcccttcctcagtagtcacatagggacgtatataataatgtgtattgggaagcagatcggtcacctctacttctaaaaacgaatagtcataattccgggtttcccgtgccaatgtcttctgatcatcaaccgtagggattcttttagtagaactgtaacaagcgccctgttctataattccgccattgcttttgaaacggacctccgcagataaatagtaactgtatcctgtaaaatgtgcatcgtgcacaaccaatcttggcaatcctgaaaggcggaatggcttcacttcactgtaacgttctccatgcgtatttccgcccaatacatggtccagcaatcccggacgtccgttatagccataattataatcaaccatggcgcaataataagtttcgcccacgggaagcatattcggttccagaaaagcataaaaagttccctctgtatcacgatgtacataagcttccgtaactacttctttcatctctcgatctttagctatcaggaatctgggatactggtagaatccggtttcttcacttgtcacttttcctatcatgaccgcgtctgtccgatacagctcttctgtattcatccccagaatattagacagcaattccacggaatcttgtgaaagcgtagccatatcacaaatccgctccaacgttaatgttgctttagaagattccatagccccccaataatctcctttattatcacaggaggtagccagcaatgtcatcagacagagcaagcccagtaattttctcttgttcatctttgtctatttatagtgttaattgccggcaaagttacaatatttattataaataacctgttggcggaattaatttgagttgataatatgtttggaaagttgcgcatatcgggaaaaagaacgtttcgttcccaaaagtcgaaacatttcgttttgcggattatacttgtaaccccgaacaactcccttttaaagtataaaccgcatacttgccttgctgcaactgaattgttccaaactctccggttggaataatctttttttgaaccgaggcacaagcgtaaaatctacattttccgtgattggttacattggggtcgtcaaagctcaatccgataaagcgagtttcaggtgttaatgcctgattatctttgagaaactccattaacttactccatgctatttcgtaaggctctacttcaccatacttaccaaatatacggatgtagactaattccaatccctcaaaatggcatacttcggattgaataccgcttctgtttccactactttgtatatatccctctaatcgggattgtagttcatctatgtatgcttttggggatattccaaactgcttcttaaatgcttttgagaatgattgcggattatcatagccaaccatttcagccaatttagtcaggctcatatcttcggcttgcatatatagcacagcccgttcaatccgttgccttgccacataagcatacagcgattcattcaaagcagaacgcataatgcgaagtaattgcctttgagatacatttatcttatcggcaatgacatccaactgcaacggcaaatgtagattggcactgatgtaatcaatgacttgattcaccttttgttggtatatgttttctgtactattacgcataaattcagttatttgctgcaaaattacccactttgctatgaactatgattgtccaatctcgccaagtttacgctccttttctctattctgttcagaatagattttataattatccgatgaaacggtcggataacaaagaaatacaatcgtccgaaccagttattgtacttcacaacggtggtaatccgaagctcctgtttgccatcccggtgttcaccgcaccacattgaaacgtgaaaatttaagtgcttgtcgggcatcccccatataatttcattcgtattactttcacacacagaatccgaaaaccgactttgggtatctaaccctaacggtttgacaattttgtttctcaatttcaagagccaatctatccaaacagggaattggttaaatgccatattaaagaaagcatcaggcgtaatgctctcttttgtcatcacctctttagagaatgaatccgaatagtcggcagggagatacttttcaatcagactgtttgttggcatatttttcatcttactactctttaaatttattgataaccacgtcttgtaactctttaaactgttccggcgataaatccgaacaaacctgctgcataccaattaacaaggagtattgtaagacagccatatccttcgcttgtttgacatccaatccgttagcttcattcaacttagctgcatagtccaagcggatacgatccgcttgtgaaacataactccgaacaatcgggttagaatagccccatgcccgtattacactttcatctcggatagaagagtatgccgccatatccccaagtttctgcaactgctcagtggtatcgtttagcttatcaacttcacgaataaactcaaaggtgtttacttctaaccagtattccatcaaagcatcaatatagccatcaatgtttttgaagtggtggtaaaatgcacctttggtaatttgcagcaatccgcatagattatctatcctgattcttgcaaatccatctttcgccaagacatcaagaccaactacaaaccattgttttttatctactttcttcataatccaaaaccataccatatagtatggtttgcaaaagtaattacttttattgaatctgcaatagtatttcttagttttatcttctacttataatttaggatgtcttttgattctgacattctgtttcttactaatggtatcattatataaactcccgtcaaactccttatatcgagcatctttgtagattccaatcagttttttgctataaccctgaatcatcgaattggatttttgggataggttagtcgctaaaattccgcttcccaatatgcccggattacagactactttatctttctttatggcgttcataatcagttctgaacatgcataacccttaatacctaccttgtctaacttctccgatacggatttattgagtgcctgtttttcattaatggtcataaatccataccacaacaaacacttcatccccaatttggtagcaccgattaatacatcaagataagtatgcccgttgctattaggtttgtctatttcgtaagggtcaatatgtagaaacgtggatttgggtaatgatggcaatagttttaatactccatctgtcgaatcacaattgaatgttctaattggtggcgtaactgcttggtgttttgcgaataattcgatattatccaatgcccttttttctaaatcaaagaatagacaccctttaacgtcattattcaatactttcatggctaatgctggagaacctaaatagtttccgcttgccatgctttcattctccaattgataataaagggaatttttcaatgtagcatctttgttcgcctcgttcaagaaatgataaataccatattcctgttcgggggtatgtgtcattgtatagatggcacacgctgaatttgtttctacatatatctgcggtttctcgatttgaagaacctcacagagaacaagatgtttgagaacatcaggttgtttgccaaagtgagtgtaagttaccataataattctgtttatcattatggtggcaatattaagcagtagaaagcaaaaaagccttgacgaaagtcaagacctctatttttgctgttgttttttgcggattctgcttagtgtttcaggagttacaccgagaaatagtgctatttcctttaatgatattcgttcttgtaaatcgggacagcgtttcattaacgccttatagcgttgttcgggtgtatcgcaatagaaccctaataagcgttggtatatctcggcaaacatggtttcggcaattcgtctgcctaaacgctgtgtttccatatctgtttcccaaaattggttgagttcgcctaatggtagtaaataaacctcgcaatcagttgttgcctgtatgctaaccgttgctcctgttctgttaatcaaagaggggtaatcacatacgaaatcattctcaaaactgtaaccaacaatccattcatttccgtttgtatctatgcgagtaaggcgaaatatacctgacgtaacaaagcctatatgattcgtcttatcgttttgacgaatcatatattcattctttctaagtattttcggtgtgccactttcaagaaatagtttctctaatctcgtggcatctacactctcactcgcattgaatttatccatgttaaatactttataattgcaaagatacgaagaatagccactacatctaaatataattcaaaagaataattgtgtgcaaggtgcaaatctatatatagatatagtttgcaccttgcaccaatgcttatacattatgaatcaaagatttggtaggttcaaaaacttattatatctttgaacctgagttttaggcagacattagtccgacaatgggcgacaaaatgttatgattgggcttaacccaagttgtaccccctaaggcataagaaaagatataaaacacagaaagtgtgagacatacgagagtaggttcataatcctgtctctccgcaaacttatcggatggtaagtggataaaaagcctacaagttcacaacttgtaggctttttactatttatactttttatttccagaacatctgagtgaataaaaaggtataataatgctaccattttataatcagacattaccgtattgatggaaattatattattttgaccggtagaaaataagctatgagactcacagaccctaaatgcaaatacatttttgccttcattcttttattgggggtcttcttatgtgggtataattccaaacagtggtatgtcacaaatcatcggattaaaaaaaacatttctcttatttattcttgttcaaaagataaaatcgggcatggacgctttgaagaacttgtaaaacaagagtttaaagcgcagggtatagagcctgtgtttgatgaattttaccttgattgtgaccgtttcgaccagaaagtagaaatggaacatatgggtaattatcttgaaattctgaaaactaagccgatagatcttattttagcggtaggggaccaagctgctttttctttgttatcgacccgtcatcgccttctctattctattcctgtggtagcctgcaacgtgcatttccctgatgaaaatcttataaaagagtacgaatccagaaaggtatatgtgttgagagatactccggactttaaacgcaatatggattttataaagtctttgcaaccccatgtaaatatggagattgtttataatattgatttaactgctcttgggcataaatcttttgacttgctgaatcgggttatcgacagaaagaatgtgcagatttgggggcataagtcagcgttttctatggagtatgaatacaaggaaatgagagaaatgatagagtattacagtctgatgcctgctgtcgcaaatcataattcagaaaaggaggaactgactgtgagcctctgccctttccggtacataaaaggtgcttctttgcttgttatgatggaaaattcgaaatgtgagcaagagaggaaggcattcttacttgataaatttgatctggtatcgcttccgatagtaaatgctctgaatataccttctttcagttgtgtacgcgagggatttggagatgggagtaaaattgtaggtggttatatggctactgaagagatctctgcacaagctgttaccggtttatccgtccggctaatgaataaagagaaaataggtatgcctaagataagggatctggagaaagagtatgtgctggattggagtgtcttttcgtcctataatggttatgatattggaaatgtggcaaaggatgtgcgtattattaattatccgttctatgaccattaccgaagggaggtttatttattgggtgtgctatttattcttgcattcattttcatatcaatcagcctgttgcgtacgcggcgacgttctctgatagaacgtaagaacttacaaatattggaagaagcacacaaacggttgactctttctgccgacggagggcagatttcattatggaatatgcagggagatgacattgagtttgacgataattatacgcgtctgacaggtatgggaaaaaggagggttaagagaagcacctttttagagtatgtacatcccgatgattctcagttattgagttctttttacggagcactttacaaatctccgggcatgcaaatacaacgggcacgtttttgttttgatgaaacggaagaatatcaatggtacgaattgcgctgccggagtctgaaagatgtagaaggcgagatgatgctggcaggtatcatgcagaatattcaggaggcggtagaacgtgagcatcagttgattctggctaaacaaatggctgagaaagctgaattgaaacaatctttccttaataatatgagtcatgaaattcgtaccccgctcaatgcaattgtcggatttacgaatgtgttgataggcgaaggttccgaagagatagatccggatgaaaaggcaagtatgcttgatatcatcaatcataataatgaattgcttttgaagcttattaatgatgtgctggaaatatcccgtctggactccggaagtctggatttcgaaataaaggaatggaatatgacagagattatgaaagagatttatctgacgtatcagccgttaattcagccttccttgcagtttcatcttgaattgggtaatccggttcctttacttgtgcatattgatcgtttccgttttactcaggttatctccaactttttgaataatgcaaataagtttactcaaaatggtcatataatattgggatgcaaagtggacgaagaacatcatgaagtttgtatatatgtaaaagataccggtaagggaatcgatgaaaaggaacttatgatgatttttgaccgtttttataaaacagacgaatttgaacagggaagcggtctcggacttgctatttctaaagttattatcgagcgattgtcagggcgtatagaagtgcattcagagaaggggaaaggcagctgttttgcagtgattttatcattggcggatgtacggaaggatcatttggatgagcttttataaagtgtcgtggtgggtgatccgcttgatctgattcagcggggccggtttcatgatagtgtgccccctgtacttacataaaaatccccctctgtcctttgaggcagagagggatttcaacttattattttctcaatgtttatttacggaaaggcggttttactaccacagctttcagcttacggccacgcatatcgatgcatatctccgtaccgaccttgctatattcaggctttacatatcccatgccaataccgattttacgggttggagacattgtgcctgaagtcacaatcccgatcttatcaccttcggctgttaccagttcgtaaccatgtcggggaataccacggtcgatcatttcaaaacctatcagtttgcggactgtgccctcagccttctgtttttcaagcattgagcgatttgtaaagttcttgccatccacgaatttagtaatccaaccaagtccggcttcaataggagaggtagtgtcatccagatcattgccatacaggcagaatcccatttcaagtcgaagtgtgtcacgtgcgccaagtcctatcggcttaatgccaaactcggctcctgcttcgaaaacggcattccagatctttatggcagcatcaggatagaaataaagttcaaatccaccggctccggtatatcccgtgttagaaataatcacatttttctcaccggcaaactcaccaaccttaaatgtataataaggaatatcggaaaggttaatgtctgtcaacttttgcagagcttgaatagctttcggaccttgtacggcgagttgcgccatattatcagaagaattttccagttcggctccttctgtattgtgagagacgcaccaattccagtctttctctatgtttgaagcgttgacaaccaataaatacttttccggttcatattgatagaccagcaggtcatcaacaataccgccgtcttcattcggaaaacaggtatattgaattttgcccggcactaaagctgccacgttatttgaggtcactttctgcaaaaaagccaatgcatgaggccctttcacccaaaattcacccatgtgggagacatcgaaaacaccgacactattacagacagtaaggtgttcgtcaatgataccggtgtattcaataggcatgttatatcctgcaaactcgtgcatcttagcaccaagtgcgatatgtttctcggtaaatggagtggttttcatgaaatgagaatttaagaattatataaataatgattatttagaagctacaagttcagcaatcttcacaatgactttcattgccttttccatgttctggatcggaacaaattcatagcggccatggaagttcagcccacctgcaaagatgttaggacagggtaaacctttgaatgacaattgggctccatccgttcctccacgaattggtttcacattcggcttcacgcctacagcctccattgcggcaaaagcagtatcgataatatgcatcacaggctcaatcttttctcgcatattatagtattggtcacgcaactcaagagtggcggtacctttaccaaactctgcgttgatcttgtttaccagatgctctatttctttcttgcgatcttcaaatttattgcgatcatggtcacgaatgatataggatacagtactctgctctacatccccctggataccgataagatgatagaatccttcgtatccggaagtatgttccggagtttcatgccggggaagcatggtgatgaattgattggctatgcggatagagttaatcattttatgtttcgcatatcccggatgtacattacgtcccttaaaaatgattttggcagcagcggcattaaagttttcaaactccaattccccgacttctcctccatccatcgtataagcccattcacatccgaatttctgaacatcaaacttatgggcaccttcacctatttcttcatccggattgaaaccgatccggattttgccatgtttaatttcgggatgttcttgcagatagacaacggctgatacaatctcggcaatacctgctttgtcgtctgctcctaataaggttttaccattggtgacaatcagatcttctcctttgtgatcaagcaattcgggaaattgagccggtgaaagcacaatgttttcttcggcacagagtacaatatccgaaccatcatatttttctacaatgcgtggagttacattttttccactcatgtcgggactcgtatccatatgtgctatgaaaccgataacaggtaattccttgtctgtattggccggcaatgttgcaaaaagataaccgttttcatccaatgttatatcttctaaccccaaagactctaattcggactttagatattcggcaaataccatctgtcccggagtactgggagtaagtcttgtcagttcgtccgactgtgtgtcaaagcttacatactttaaaaaacgttctactaaattcatatcattaagaattaataatttgctaatctattatttttcacgcctgtaaaggtaaaaaaagagccgtgaactgccaagcaattcacggctcttttttaatacattattctatatttaatcactaatagctacttagaaacagctggagccatcgaaacaatgggtgcagaccttacattttggcagtccgatagcttcaattagtgtttcaatcgtattgaatttgagggaagaaagtccaaaacgctcagcaataatacttaccattttttcatattccggtgaaccggtagtagcatatttatccaggtttttgttttcatctccttccaagtcctttattatttgtctggtgatcagttccatatctgattttgaagcagtaaacccaataaagggacagccataaatcagcggtggacatccaatacgcatatgtacttcttttgcaccataatcaaaaagtattttcacattatcgcgcaactgcgtaccgcgtacaatggagtcgtcacaaaagatgatacgcttgtcctgaagcattgcacggttaggtattaatttcatctttgccaccagagaacgtaattcctgcttactcggagtaaaactacgaggccaggtgggagtatatttagtaatggctctatgataaggaatccctttcccttctgcataacctaacgcctgtccaatacccgaatccgggattccacaaacgcaatcggcgtcaaaattatcctgttctcccattttcattccgctcgtgaaacgcacttcctctacattacggccttcatagcatgaattgggaaagccgtaatatacccaaaggaatgaacaaatctgcattttatcgttgggcttacggagttgttctaaacggtcggcgtgcatacggacaatctcaccgggacctaaataacgttctatttcaaaatcaagattcggaaaactgttggattcactggtagcagcataagccccctcttttttaccgataattataggagtacgtccccatttgtcacgtgcggcaatcactccatcttctgttaacagaagcatggaacacgatcccttgatatggttatatacgttttcaatcccttcaacgaagtttcttccttgaataatcaataaagcaataagttcagtctgattggtgttacccgaactaagttcggcgaaatgcatgttttgtgagagtagttcctcttcaagttctttgaggttggtgatctttgcgactgtaacaatggcgaatctgccaagatgtgaattgataataatgggttgtgcgtctgtatcactgataatgcctataccggcatttcctttaaatttatcaagttcctcctcaaacttagtccggaaatatgaactttgtaaattgtggatcgaacggataaatccttgttcttcactatatgtcgccagtcctccccgttttgttcccaggtgtgagttatagtctgtgccgtagaataaatcggtcacacagctcgttttcgagactgttccgaaaaaacctcccatatgattcttttttgatgttgtttttaaaaagatggcgcaaaagtacaaaaaagattcgtgttggcataggtttctataagaaatcagtttttcaggcgatcctccagaaacgcctgtaaaatacgggcatgattataaaccggttccttagaagcatataaaagagtgactgttttataaggatgtatccggactaaaaaatcagctactttatcggaggtttcaagctctttccggtacattgccgcaaattcttcccaatgtcctgggatatctccgtgaaaccattttctcaaatcggaagagggagtcagttccttcgcccaataatcatactttaaatattctcttttcattccacgaggccaaagccggtcaaccagtacacgatagccatcctgttccgaaggatcttcatatacacgtttaattcttatctgattcatatcaatgatcttttgattataataacttaatagaaatagaaaaagtttatggaagaaaggacaaatcataataccttaagaaaatgtgagttttaaaatataaacattgtaagtgcatcgttcttcaagtggagattgataagagaagttatgaaagatgaaaatcggaacataaggaattaacaaaccattcattttgtttgtagagcttcatattggtattatacctatttaattattataatctgctgagaaacaattttatgtgaatagctctgcaaagcgatctaaacgctctttttctattccaattataaatacctattttacaaaggtttgcatttaattcaaaatttacttcccagaaataggcttgcggaaatttgcaagctacaaaaataaattatatttttgcggctgtttttgcaaaaccggtttacatgaatcggatcgataaaacaattattggcgaataattaactattaatgtttaaccaaaccaatttaaaatttagaaaaaatgaagaaaagtattattatgtttgcattagcagcattgatgagcacaagcgttttcgctcaaaacaatgatgcagaacgccttccggggtacaaaacaactttcgaaggtaatggattttggaataattggtatatgtctttaaactttggtgcgcagtctctcttcgctgaaaactctaaagatgcaaaattcagaaacactataacttttatgccgactctttcggtaggtaaatggttcaacccttattggggagttcgtttgcagggtacaggtggctcattgcatggatttacatctggagctaattcaatgttacattatcaatatggtgccgttcatgcagactttatgtttggactgatcaatttcttcgctccttataaagaaaatcgtcgttttgacatcgttccttttgcaggtatcggtggagcattcatccgcaaaggtgaccagtcatttacaatcaatgcaggtattcaggcacgctaccgtatttcaaagcgtttcgatatcaatgttgaataccagggagctattttagacgacgatatggtagttcgcggcggtttcccgaacgatggaatcagtgggctgacagccggcgttactttccgtttcggaaaaaccggtttcaagaaaggttactcttcacgtcagtacaatgcaattaagagcaactattctgacttagaggcaaactatacttctttgaaaaaagaaaatgctgcacaacaagccgaaatagctgagttgaaagcacgtaagccggaggttgtcaaagaagaaaccgtaatcgataattcagaaatcaaggccctcccaagtactatcactttcccgttcaacagcagtaaaattgaactctcacaggaagtaagtatcttcaatattgctgaattcttaaaagcaaatcctgaaatccgtgttcgtctgactggttacgccgacaaacgtggttcggaacaagctaacagaattgtttctgaaagacgtgccaatgcagtgacagaggtatttgtcaataagtacggaattgctaaagatcgtatcactacagaattcaaaggtaccagcactaaatttgaaaatgatgactggaaccgtgcagtagttgtggaattgattaagtaataacaattatactaccttttttaagaaggcgcattgatagatcatatcaatgcgcttttatttttaatggccttttttcagctctgccgcacattccgcgcaacatccttttaatacataatttatgcttcgtacggcaaatccttcaggcaaatctactacggggacatgaatgttttcaaggcagaaagtcttatggcaatattcacagtaaaagtgcgtatgcaaatctttcacggcacaagtacattcactgtcacaaaccgcatattttaaagatcctgtaccatcatctacgctatgtgccagatgttgggaaacaaacagggtaatcgttcggaatatgctcgacttatccacagtatccagtttgttctccaaatcaagaagtgaaacagcttgttccgcatctatcatagcttttaaaaccagcatccttatggcagtaggttttattcctctctgttctaatatcttcaaacacaaattttccattctcatttaatcattttctgtatacgaatagcattcactatggcaatcaatgtcacacctacgtctgcgaaaactgcttcccataaagtcgcaataccacttgctcccaataccattaccagcaattttactccaaatgccagcgatacattctgccagatgatgcggcgcgtacaacgtccgacctttatggcagtcgccactttcgaaggttgatctgtctggataaccacgtctgcggtttcaatagcagcatcacttcctaaccctcccatcgcaatacctacatcacttaaggcaagtactggagcatcattcattccgtcaccgacaaaagcaatccggttatctttgttttccttcagcttttccatatgctctacctttccttccggtagcagatcaccatacgcccgggtaagtcccagtttgtttgcaaaaatgctaacaatactctgtttatcacctgacaagatctgaatattcttaatatttaactctttaagtgatctgacagtatctgctgcatcgtcctttaacacatcggacaatgtaatgtaacctatatatttatttccgacagcacatacgactgttgtttccgttatcgaaagaatatacgccggaaactcaatggaatatttcgacaacaatctggcgttaccgaccaacactttttctccgtcaacctcagtcattaacccataacctgcaacctcttctatattctcagcagcagtaaggccaatctttttcttttcggcataactaacaatagctttggctatcggatgagtactatttttctcaacggaagctattatacgtatcagttcttcttttgaaacgcctggaataacttcacaggattccacttcaaaaactcctttagtcagagtacctgttttatcaaatacgactgtattgacacgggttatggcatccagataatttccacctttgaacaaaatacctaaacgggaggctgctccgattcctccgaaatatcctaatggaatactgataaccaatgcacacggacatgaaatcaccagaaaaaccaatgccttatacagccaatcattaaaaacaaatccgaataacgggtttatgaatgaatagatatatgggatcagcacaatcaaaaaggcaaggccgataacaataggggtatatatacgggcgaattttctaataaacaattcggccggtgctttacgttcagaagcgtcctctacaagttccagaatacgagccaatgcgcttttatcaaaaggctttgtcaccttcatccggatcactttgtctgtaacaatcataccggcaagtacctcctcacccttgcgaatatctcgtggaacactctctccggtaagggccgctgtgttgaatgctgctatttcgttaagcataattccatccaacggtacacgttcaccggcttttatttcgataatttcgtttataaagactgacttcggattgactgtaacgatctcgttccctctcactaccattgccttttcgggtctgacatccaacaaggcactgatattacgtttagccttgtctattgctcgatcctgaaataattcaccaactgaatagaacagcatgacagcaactccttccggatattccccgatataaaaagcgcctaatgttgcgactgacatcaacgtaaactcactgaagtaatctttctggagaatactttcccatgcttcctttatcacaggtaagccgacaggcagataggccaatacataccaaaccaaagaaactgtattttccttgaaaaaagcaatatccagttgattcattataccgcctgctaccaacatcaccaatgaaagcattactttccaatattcgcctatgaagccatttgcttcctggcaatttctgacccgcatacttgcattcgtttcacatttgcattgtcccataatcatgtttattattaggtttatgatgcaaaggtagcggattgcaggtgcaacaaagttgcaaaaactcaaccgaaaaagtttcgaaggcatttcggaatccgggaaggtactttttacatcaaaacaggtgcaaggaatttaaccagaaaatatcccccggcaattagccatagatacaacagggaagcaagtataaatggtttggcaccagcttttttgaatttgtcaatgctggtttcggctcccaatgcagtcatcgccatggtaagcaaaaaagtatccagattattgatgaaagtgatcaacccttgtggcagtaaatcaaaagaattaaaaccgataactgccagaaaaccgatggcaaaccatggaatggatatgtctttcatgcggccgccttgtccgcctgttttcactgctgccctggataccatgaaactggtgatcaacagtaccggaaccagcatcattacgcggatcattttcacgataatggcaacatcggaaatttcttttcccatcgcatttcccgcacctaccgtatgtgcaacttcgtgtaacgtagcaccggtaaagattcccatttcgttgggcgacaacataaaagttccgtttctatataatataggatagataaacattgacagagtaccaaaaataactacggtggacacagctaccgcagttttgtatggcttggtctggatggtcgattcagcccctaaaatagcggctgcaccacaaatgccgctaccaatggaagtcagtagtgcgaccccacggtccatcttaagcatacgtccaattaagatacctccgagaatagttgtagctactacaatggcatcgataaatatggcaggtagccccactgccagcacatcctgaaaagtcaatttaaaaccataaagaataatgcctatccgtaagatacgttttgagcagaactgaatacccggtacccatgtttccggaagattgtttctgaggctattggcatatagcatacctaaaataatacctacgatcatcggactgaaagagagtctttttatgaactccatgtcgcctatgtaaaaggctgcacatgaaaacagggctattaacaagaccccgtgaagcatactgtttcttttttcgcttaacataaatgaatttatttatagtgtttttattagtacaccacaaagtaagcactttaaatcgggacgcaagcaattaaaaaatttataccccataacttatcgttatttctgttcttgaaaatatgttccggttttgttattataaaaaagccccatccaaagtataatctatacgcttgggatggagcttgatttcaggaaaagtcagtcagactgatcactatccttttatttttctgcaggcattgccggtgttgtgggccaatatggattttggtacagcggagataaatggacggatgtatggtcagaagctgtcaacaggaattgtttaattggcaatggttgtaaataatgggccatatgccagatataaccatccttatataagttcccggatcccatatttttctgataaggccggagatactcacttaaactggcgtttgagacatttgccgatgaactaccgtcagcaaccaactgaccggcatcataccattgttccatcggagtgttccaaagatggattccctccacatgatacggttccaccatcatctgctccaatgctctccaccgtattagatccatccagcgtaatccttcagccattaattcactgcgacgctcccgacgcatgttatacaaaacagggtcagtcaataatgatccggcagagtatgcgccccaatctaacttctctttttccatattggtggatgcgatagtcacttgagggtcaatagcggttccattgaagccggctgctgtacgaacggttttccaatactccaatatctttcctgaagctatattcttcgtcaactgatactcagcttccatatagttcaaaaaagcttctgttgcacgaaatactattgatccggtatagccggttccgttaccacacagctttttatcgaatgtaccacctttgcgaattgcatatcctgtactatagcctttttcttcgtttgtcgataatatgaccggatagggttcatactccattcccatttcctcttcagcatccatattcttaaataaatttttctggttcggttctttcaggaatatgtgtaaacggggatctgtattttctctgactgatgccaaggttttgtcatcataagaaaaatcatcatgggatgcataaacaggcttgccgtccttcatgacaaagccttctaccatactgcgggttaaaccggtaccatagttgccatgttgaaccgaaacctcgatgttattcacaatactcagtcctttgctgtattcacgccaaagcaaaacgtcagggtatccggacatgtcgatattgccaaacatgctgaaataaggattgtcaggatccgtttccgattgaggcaccattcctgtattttgagttaattgtcctttgtacttatcagcaacagtttctgcactttttgctgcaactgtaaagaagtaggttatttcattatcgatattacccgaaggatattcgtagttggcattatactctttatctttaccgggccaaccttcaccgttcggtacaaaggcagttcctttaaaatagtgcaaccatgagccctcaaacaatcctacacgcgattttaataaaagagctacatccggagacaggcgattgcgacggtcatcaaaattgtcgctcatataaattagtgcactgtctaaatctgcaagaatgaaacgggccacttcattgcgtgggctacgtttgttggcctctaccaggattgtttcatcatccggcatagcttctttcaagattggtaaatctccccacttttgaagcatatcaaaatatgcgtaagcgcggaaaaagtaaatctcgccaatatattgacgaatattgcgctctgagccggaaattcctccttgattataataacctaatattgtattcaaggaataattgatattgcggatattgctccatgaccagttgccgttggtttgcccaaccttccactgatctgttgcatatctgccgtctgcggaaaaagttgcctgattgtctgtgtgaacatcgtaggcaaaagttccataattcccgccatgagagggcaatacatctgtatatagtttattggctatggcctgaacctggctttctgtttgataataatcttccggaactacataagaaggaggttgcttatctaaaaaatcttcacaggcaacaaccgaggtagcaagtaatgctacagatacaaaacgtagaatatttaatttcattgttatcttccattaaaatgttacacttaatccacatgacagagttctcgacaacggataaccgttacctcccgaaccaccggagattgtttccggatcaaattgatcgaccaagcttgtcccggtccacaaattttctccggagaagtatatacgtaaattctggactccataacgagaagtcagtctggtagggaatgtatatcccaactgtaagtttttcagacgaatataagcagcgctctgtaaatagcgggtctgtgtctgtagattcttattgctatatagtgggcgaggtaaataggaattaagattaggactctgatagccctcctgaaccgaccatgtatcatcattacggaagtaatcacttacactttcaattccggtagcatgccacattccgctattgcttgcaccaaacagataagtacttccttgccagaagtcgcgtttcataaccccttggaagaacatacggagatcaaagcctttccaggaagcattcagatcaagaccaaacagataacggggagttgtattacctataacagtccagtcccccgtatcattcagtgtccccgaaccaccggaaatcttaccatcaccgtttatatctgcatacataatatctcctgccttccagtccgaacccaatgcgctctgtccaccgttaggcattgttgctaaatgggcctgcatttcttcatctgtctttgcaagtcccactgtagtatatccccatatctcattggtatagcgtccttcaatatacgtactgactgctttagtcggattattcggatatcgtgtgattttcgtacgggcatccgagacgttaaatttcgcgccatacgtaaaaccattattcaagcggtcattccaaccgattgaaagttcccatccggaggttctcaagtctgtattgttggtaatcggtacacctgtacccagcagagccggtagttcgggagcgttgccaaccatattttttgtatcgcggatataccagtcgaatgatccggtcaaacgattattgaatactccccaatccaatcctaaattataactctcaattgtctcccaggttaatgaagccgaaacaagtcccggagccgaagcggtattgggtttattgccactcatcagccatgcgccattcgaagaacccaccgacatggtttgataagtctgataccagttcgttgtattttggtttcccaataaaccgtaggaagcacgaaacttaagaatattgacaatattgttcaaaggttcaaagaagtgttcacgcgcaacattccatcccaaagagaaagaaggaaaggttttccactggttgcctttgcggaaacgtgatgtgccatctgcacggagatttgcttcgagcagatactttccgtcataactataattgatacgtccgaaaaatccggctgtagcccagtcattgcgggatccattgacagatggggttatgggattcccgtcgtaatcgagcccgttagtcaagtctacctgaggtttattcggaaacataataccgtcacgttgcagaccgaattgagtttgtttcagattttcagcctggaagccacccattacatgaagatcatgcttttggttgaattggtgtgtgtattcggtatatatattgaaattataataattctctttataataatcttcgtgtacattcgaatatttgtcgcaagcataggcattgccttccacatcatggttgtaaagcacttgtttatcccagtagttattggccgacttgatacggtaattgaaatccacgtgtgtaatccagtcttttaccggttcgaaagtaaaactcacttgatgatacatgttatccgtttgaatcttaccggttcctccttccgctaatcccaatatgggagaaggggcataaaaatagtaaccgttgggatcatacaaaggtaaaacaggccaaccttgacgagccatgtccgaatatagagagttagtcattgttgtggggcgtttgtaatcttcccgggtaaatcgcattgtatagtcaaacttgagccatttagtcagttcggaaccaatctttgcagtgccattgtagcgagataatccctcttctcccagattcataaaaccaccttggtccagataattgaatgaagcataataattcaacttcttagtgcctccattgacactaaagttatgttcttgtgagaaggtccactttttaaaaatcatatcataataatcaatatcatctaccccggtcacatagccatcttgccagtatccgttatcaccggccaagagggagtacaagatagtcccatcgtcagtgatacgttgtgcaggtccgtaaggtttggcattgtgataggcaacaatctttttcatacgatcatttgtaatgtaggttccacctcctccattggtattggtgtcattgatccaactggcaaagtcaaccgaattcatcatatggttcatattaatcgggtttccccagcggaaactattattatagtttacctgggttttgccttccgtgcttcctgatttggttgtgatcaagattacaccgaatggtgcacgtgaaccatatattgatgatgcagccgcatccttcaaaacagaaatattggcaatgtcctgaggattaatggaattaagatcaccttccattccatcaactaaaaccaaaggttcaccgctggttccctgtccgatagtggtagtaccgcgaacatttacacttggtttatcttccaggctaccgttcgtctgtgtgattcgtagtcccggaaccataccttgcaatgcttgtgccgcattggtcaccggacgttctttcaactctttggctgaaacaacgctgacggaccctgtcaggtttacctttttctgggtaccgaatcccacaaccacgacttcatccaaaacctccgaatcttctttcaaagtaatattatacgattttcccggagacgtttttatttcctgagacttatagccgatatatgaaattacgactatcacaccatccgggacagacagagaaaagtccccctctaaatttgtcacgactccattagtggttcccttttctacgacgctggctccaataaccggctctccattggcgtccgtcactttgccggaaattgtatttttccgctgaaaagtctcttttactacaacattaggcttgcccgatgttgcaaagacagccgagggagcaaacccggcagacagcaataaagccaatagtaacttacaattgtttttcactttcatgtttttcatgtttttaattttccaatcacataaaattaacgttaactaaataaatgtcattaaattaagtatatcaagtttggccaaaaatgattatatctccgaatctaacgcagttcctttcttctatacgggttatttcgaattcctatcgaacatgtcttttatttcctcaaagttttcaatgattgtaggatcgaaatctgtgctattcatgtatttcagtaatgaaacaagcatttgttttgctaccggtctgttctctaaatcagattgcaaatcgaaagtggctaataccaatttgcctccatgcactttgccttcatacaaagaagccagacggcgattattagtaaagttatcgaccatttctacaataggggtccctccctgtatactatctgttatcatggttttggagttcttatttaaatcccaccattgccaatcggtgtgcatgtctgtcggaaaatcagccaatgctttatgagccggattacataatactcccattgtcccggcctgattcggaaaatgtaccgggctccagaatacaggtacgaatttgccttcgatacctttcatctttttccaatccggattgaaaaggactttttgcccttcattcagccatgccatggcctgatcataattacgggtatatttcacattaccccattctactttttctccttcaggataaacccatatgttccatctgtttacataatctgttccgattacttttacacacacttccagttttgaagcattctgtatgtctgtcaagggtaccgatatctcacccaattttccattataaccaaatttcaattctcctacttgtatttcaccatgctttacagaacgtcctttatccagaatatcccaatgcagtgttttgtttgtcagaatatcgtttccgtaattgcataactcgatcttagcttgaaacatttcatcgtttttatatactgctttaggaaagcgcaataacggcaccaccggtgaacaaaactcccggaaggctttaccgtcgataattcctttactttcccagaaggcattcaatagtccgacgagtgctgttccttgtcccggaaagtcatgtaaatcaagtaattgaaaaccactgattccatcagttttcaatgcacgctcaatttcttctttatataagattgcggctaactttccggaagccattaaataatcgggtgctttatcaagtaatttctttttttcaagatcattcttcacagccataaaatttaagggtttcagaactccggtatatttggaaatctcggttaaatccggataaaccgaatattggcctatttcgtgcgtaatcagagggacctgtatacctgcaaccgactcactgtaatctttatcgaatgtaggggatagttgattgaaaactccctgtccccgtacccagcctttattggtccactgcgtgacaaagaaatcatcgtttgattccggccatccgccatgtccgccttcgaacgtaaacgaagttgttacgtataagtgtctgttatcctttgctttcaattcgtctaacattacagacagaatggtgaaatctccctgcaattcgtttcccaggctccaaaggcaaaaagaggggtgattgccgtaatttttgataatccggtctgcttcttctcttaaaaagcgtacggcacttgaatcctgcccaattgtaagtacccatgcaggaagttcaacctgtaaataaaatcccatttcatctgctgcttcaaaagctgcttcgggagggcaccaggaatgaaaacggagatgattcagcccatattctttggctgcggcatatactttttgccagccttctttattcattggaggagttccggttaatgggaatatgcaacactccaatgtgcctcttaagaacaaaggtttattgttcatcaacattttatcaccgtttgtttccaattggcgcataccgaaatcttcttttatttctgatactcttccattggccttcaatgtgaccgtagcctgatacatttcaggagtaaattcattccataatatcgggttatctcccatgttgtaaagcaactcaaccgatgaggctccggctttcacatccatcttttttacctgctcttcaagttgttgagagccgtttcttgcagatactttcatcgaaagcaatgcatgttctgcggcaggtgtattgtttgaaaacgaaataacggcttttacctgtttgttttttacatcgggatatagttgtacgctttctaaacgtattttttccatggcccggacagtcatatctcctaaaataccattccatttaatttgtgtatgatctgtatatgcatgtgccataccattggagatatcataacgcttgcgattatcgacgcgtatggtcagaatatgctttttaccgcatgtcatataaggagtcagattgtagcggtgtggcgtgcttaagctttcttcatgtccttcgactttcttattatctacccaaacctgagtatcccacaaggctcgttccaaatccagaaacagctctttatcattccattgggcagggaccgagatctctcttgagtaccatgcaactcctacgtaattgtgcaaacgtgtgagatataataactggggttttgacagtgcaggttccaaggcattgggggttccaagtccggcatcgtcagttgtacccggtaactgcatggacgtttcaaacaggttgccttgccatgattcttttattccaacatctgtactgtccagcctgacagtccactctccggaaatatccaactgtttcttttcagaagaacatgatgtcgacagaataatgatcaataaagaaaatagtagttttttcatattattacattttaaatattacaaatagctgatctttcaacattgcaaaatagctaagaaaatataaccttgaaaatgtaagaaaggactgttatgatgtataaaatctctaattttaagtgattatatcattgattatctttagaaataccctaataaccagtgtttttagattaattcaataaaaagagtcgaaaaatatctcgttttataataaagatgtatatttgcaaaaagagtgtaactatggaacgcaaaaaagaaggatttaccaatcaaagagcgattgttcttcctgaagctataaaaaaaatattggtcggcaacgagctgactaatttgttgtatgtaacggatatcgggtattatccacatgccaccggacactatcgagccagaagatatggttcgcaacagcacattcttatatattgcactgagggagagggctggtatagcattcacggtcaaagacagaaagtatgcaaagaccaattcttcattatcgaagcgggcttgccacacatttacgccgcttcagaaaacagtccatggagtatatattggttgcatttcaccggagaaaaaagtcatttgtttaattcattctacaacaaactgcataaaatagatgaatctcccaacgcacgtattaaagatcggatgcagttgttcgaagaaatttaccagaatctggaaatgggatatagtattgaaaacctggaatacactacactgtgtctatggcattttatagcttccttcaagtttgtttcacagtttagagaaattaatcgggccaaacaaggagatgtcactcaggaagcgatcagttatatgagaaagaatatcgaaaagaaactctcgctggatgatatagccggcagtgtcaactactcatcttcgcatttcggacaagtgtttttaaagaagtccggatacactcctttaaattacttcaatcaattgaaaatacaaaaggcctgtcagttacttgacttttcagacttgaaaataaaagaaatagcagaacaacttggcttttatgatcaataccatttctctaaagtattctataagcagataggcgagacaccaagcagttacaaaaaaaggaataaaggataaaaaaagaaaatgcaaaagtgcagctgataaatgtaggaaagtagtacttaaagtttgtttataaggcaaattgagtgtatcttagcaggcaagatgtatatcttagcggccaagatgcaaatcttagctgctaagatgcacatcttgcgacgcaagatgaacttatcgcctaagggaggccatttactgaagtagccggagcgactttgtccggcatacttggcaagtttttacctttacttccgacaagcccactctttatcggttttctctattcaccttttaaaaacattgcaagctatggctgaatatcaaatgcaagaactgactcttcccaatgaggaagacaagaaaattcttttcccgcgcatgaaactgtccgggcaagtagacttaaattacattgcttcacacattaattatgcaagttcttttaccccggggaatatcatcggactgacgaaggctttggcgcaggccattgcctatgaaatggggcagggacattcagtgaaaatcgacggactgggtatctttactccttcactggggttacgtgacggagctgagcgtgagagtggtgagaaaggtggtaaaaaacgtaatgccatgagcatctgtgtaaagaatatcaattttcgtgctgacaaacaactgatcattgaaacaggagaccactgtatgctggagcgttcggaatggaagttcaggcactcttcgcaattctactcagagcaggaacggctcaagatggcacaagactatctggctgtgaatcattttatgaaagtggcggattattgtcgcttgacggggttgttgcgtgacaaggctgcacgggagttgaaacgctggaccaaacaacctgaaacaggtattgattatcggggacagggctcgcataagatatacatggtccgttccaacttatgagtgtgtccttacaaaaaagataatcagtgcatacgcatcgcgttgccgggacatatcggtatttttgcggaagaaacctgattccgactcgtcttaaaatgacttcatgttattattgtgtgaagttgttttagggcaagtaagataccggacaccattgattgcggatatgtatcggacagattttaaatgatctgctttctttataatatgcatccgctcttttcttctctgtttacgaaatatttttatctctaaataatcactatttacatccatataaactctcgtatttgcattatattccatattctgcgtttattgatttctttgaattaatatatatttgtatttttgattcacttttatatcacaatgaaaagaatgattatattgatcaagaagtgaagtttttactctctatgaaataataatgtaattaaatagtgatagatgtatcactgttttcagtgacaaaaatgtatttaatatcgttttatggtggcaaatagtgaagcgaataatacgtgattgataaattttgaaatattttttctgttaagtatttgaaatgataaatctatgcgctatatttgctgttacactaaaagatactaaatgaagaattgctcttattgaaataatgttaactgtacggctaacgctattggatccgttaaataagaattcaacaagagaaagaaaagatatatttgataataaaattttataggggtattacacttacataacaaattactttattataggtacaagaatattggggggagatgcgaggatattacagtaagtcaattgacattattattgctcaaatatcagttgaaaaacgagatttatacaggataagctgcattggatgttttgttcactgaataataaccggaattgacgttaatataaaagttctatatatgaaaaaaatatatctgttattatcatttctttctgcattttttttgctctcggcttgctcagatgatactgagcaatgtttatattctcctaaggtatttgataccggtaatttattgagtaataaagtaaaagaggaattcttgaattttgattatcctgctggaattgttccggttctttttgcggcagatagcatgaggttgaatgagttaaaactcttttttaccacaggttcatcacagactaatgatttttataatcaatgacttatagtttgctctgtgtcctctgtggtgagtttcggcacaccctttatgttgatgaatgttttgatgatcttgcggattcaatatctgaatcaaaagttctcgttcaagagttgaatgctttaccttcgtctaaaaatatcggataaattctgccgtgtctgttatttctgcattgcctggaatacatagggactccctcggagaacttttacggaaaatgtgcttttacctcctatcctatcctttgggcggataatgtgtgaagatctattatattataagtaacaaagcaaaagagtgctttgagcatgctgcacaattgggacattcgctcgcaagttcgaaagcccggcagatagaaggtgagatgagcaggttataatacgtgattttattgtttttctgtttttaattagtagaaaacattaattttgcattcgatttaaatccgattcgaatgtcacaacttccaacgttaatagccgacctcgctctgattttgatttgtgccggtgttatgactttgttattcaagaaactgaagcaaccacttgtgctgggttatgtcgttgccggttttcttgccagtccacacatgccttatacgccttcggtgatggatacagccaatattaaaacctgggcggatattggagtcatctttttgctttttgcccttggactggaattcagttttaaaaagatagtgaaggttggaggtacggctgtcattgctgcctgtaccattatcttctgtatgattctgttgggggttgctgtcgggatgggctttggttggcagcgtatggacagtctgtttctgggcgggatgattgctatgtcttctactaccatcatctacaaagcgtttgatgatttggggttgcggaagaaacaatttaccggtttggtgctcagtattctgattcttgaagatatacttgccattgtgttgatggtgatgctttcaacgatggctgtcagcaataattttgaaggaacagagatgttgagtagtatcggtaaactactttttttccttattctttggtttgtggtaggtatttatgccatacccgaatttctgaaacgttgtcggaaattgatgagtgaagaaacattgctgattgtttctctggctctctgtttcggtatggtggctatcgctgccaatacgggcttttctgctgcattcggtgcctttattatggggtctattcttgccgaaacaattgaggccgaatctattgaccgattggtgaaacctgtgaaggatttgtttggagctatcttcttcgtatcagtgggaatgatggtagatcctgcaatgattgttgaatatgcagttccaattatagctattacattggcagtaatcttgggtcaggcttttttcggcacaatgggcgttatgctggcgggacaacctttaaagacagccatgcagtgtggttttagcttgacacagataggggagtttgcttttattatcgcttctctcggtttgtccttgcatgtgacaagtgattttttatatccgatcgtagttgctgtttctgttatcaccacatttctgactccttatatgatccgtgttgccgagccggcttcaaattttgtagaccgtaagttgcccgagtcgtggcgacgtttcctgatgcggtatactaacggttcccggaccgtcaatcatgaaagcctttggcggaaattactatttgccttggcacggattctggtggtttactccattgtcagtatttctgtgattaccctttcatttcgttttgtggtgcccttgtttcgtgaacatcttccgggtatctggggaccactggcgggagctgtttttactattttgtgtatatctcctttcctgcgggccattatggtgaagaaaaaccattcggcagaattcatgactttgtggaatgacaaccgtgtcaaccggggacctttggtttctacgattgtgtttcgtgtagctgtttccgttctgtttgtcatgttcgtgattacccgtctctttaaagcgtctgtcggattgatgttcggagttgccttgttgctggtaatcctgatggttctttcacggcagctgaagaaacaatctattttgatagaacgtaaattttttcaaaatctccgttcccgtgatatgcgtgccgaatacttgggggagaaaaagccggcttatgccgggcgtttgttgtcgagagatttacacctgaccgattttgaaattcccggagaatcggcttgggccggaaaaacattgcttgagctgaatttgggcaaaaagtatggagtgcatgttgtttctattctacggggaaagcgtcggattaacattccgggaggttctgtccgtttattcccgatggataagatacaggttattggtactgatgatcagttaaatacatttgcagaggaaatgtctcatgtttctgttatcgattgggatgtgtttgagaaaagtgaaatgacattgaaacaattgttgattgatactgattctgcttttctgggcaaaacgttgcgtgaatcaggtatccgggataagtaccattgcctgatagccggtgtggagcggggaggagaggctttgatgactcctgacgtaaatattccttttgaagaaggagatgtggtatgggtggtaggtgagaatgaagatgtataccggttaatagggcaaaattgtgatagaaaacgttaacaggatactggcatatcataaaaaaatgcgatatttgcgaaatgattcagatagagactatacttgatatacttgttaaaggattcgtgattggcattgtggtttctgcaccgctggggcctgtaggtgtcctttgtattcagcgtactttgaataaaggacgctggtacggattcgttaccggtctgggtgcttcgttgagtgatattgcttatgcccttctaacgggatatggcatgagtttcgtgttcgattatatcaataagaatattttttatctacagcttctcggaagcattatgctattggtttttggtatatatacattccgtagcaacccggtacaatccatccgtccggtatcagccaataaaggttcttatttccacaatttcatcaccgcttttgcggttacactttcaaaccctcttataattttccttttcatcggtttgtttgcccgttttgcatttgtgcaacccggtgtgttggtttttgaagagataaccggttatctggccatagctctcggagcattggcatggtggttcggaattactttctttgtcaataaagtgcggacacgattcaatttgcgtggcatctggattctgaaccgggtgatcggaagtattgtgatggctgtgtctgtgtttggattgatattcactctgttgggggaatctatctattaatgtaggagaaaagaaagaagatgaaaatagcgcaacaactgaaagaaaagaatattgccgagtaccttatatatatgtggcaggtagaagatctgatccgtgccaatgattgtgatatcgaccggattaaggagaacattatatcccgttacaagattggcgatgaagaacgctgtgagttgacggaatggtattctaatctggcttcaatgatgcgggaagagggagtccgtgagaaaggacatctccagataaaccgaaatgtaatcattaacttgaccgaactgcatgcagctttgctggcgtcgtctaagtttcctttctatagatcgtcttacttcaaagcactgcctttcattgtagagttacgaaatagaaacggtcaaaaggaagaaccggaacttgaaacctgtttcgaggctttgtatgggatgatgttattgcgtttgcagaagaagcctatcagcccggagactacaaaggcgatggaggctatcagcagtttcctgtctatgctggctaactattacgacaaggacaaaaaaggagagttaaaattggaatagaaatgaatacgattcaccacagagtacacggaggacacagagttttaatctcttgtttattaagatgtttaagaaaaagatattctctgtgttctctgtgtcctccgtggtgaattaaactcaaaaaaagatagaaatgaatatattagtcaccggagccaacgggcaacttggcaatgaaatgcaggtgcttgccaaagaaaacctgcagcatacgtacttttttacggatgtgcaggagttggatatttgtgatgaacaagctgtttatgcctatgtgagtgaacacaaaattgatgccattgtgaattgtgcggcttatacagcggtggataaggcggaagacgatgctgaattttgcgacaaactgaacaatgtcgcaccaggatatttagctcgggcggcacaagccaacggagctgcgatgattcaggtttctaccgactacgtgtttgatggcacagcccatatcccttacacagaagatcaacccacttgtccggcctcagtttatggctctaccaaattgaccggtgagcagaacgtgatgaaccattgtgaaaaagctatggtaatccgtacggcatggttgtattctatctatggcaacaattttgtgaaaacaatgattcgtttaggacgtgagcgtgagtctttgggggttatatttgatcagatcggtacgccgacttatgccaatgacttggctctggctatttttgcagcccttaataaaggtattgtccgtggtatctatcactttagcgatgagggagtttgttcttggtacgactttacaatagccattcatcgtttagcgggaatcacttcatgtaaggtgaaaccattgcatactgctgattatccggcaaaggcacctcgtccgcattattccgtactcgataagacgaaaataaaagagacatttggcattgaaatcccgcattgggaagaaagcctgaaacgttgcattaatcaattaagagtggagaatctgtgattcttcatcctcaattcttgaaatatggcagataatacagaaatattaagaaggcgcactttcgccattattgcacacccggatgccggtaagacctcactgactgagaaattgttgttgtttggcggacagatacaggtggcaggagcagtaaaaagtaacaagattaaaaagacggcgacttccgactggatggagatcgaaaaacaacgtggtatctcagtcactacttcggtgatggaattcgattaccgggactataagattaatattctggacactccgggacaccaggattttgccgaggacacataccgtaccctgacggcagtggatagcgttatcattgtggtagatggcgcgaagggtgtggaaacccagactcgtaagttgatggaggtttgccggatgcggaatacaccggtgattatctttgtcaacaagatggaccgtgaagggaaagatccgtttgacctgctggatgaactggaagaagaactgatgattcaggtgcgcccattgtcgtggcctatcgaacagggtgcccgtttcaaaggagtttataatatttacgaacagaaactcgatctttatcaaccctctaaacaggtggtaacggaaaaagtggaagtggatattcattccgaggaattgaacaagcagattggtgatacgctggctgataaattacgtggtgatctggagctgattgaaggtgtgtatcctgaatttgatgtagaaacttatttgcagggagagtgtgctcctgtatttttcggttcggctttgaataactttggtgtgcaggaattgctcaattgctttgttgagattgctcccgctccccgtccggtacatgctgaagaacgtgaggtgattcccgaagaacctaaatttaccggttttattttcaagataacagctaacatcgaccctaaccatcgttcatgtgtggcattctgcaagatttgttctggcaaatttgtaagaaatgcgccttatttgcatgtgcgccatggcaagacgatgcgtttctcttcgcccacccaatttatggcacagcgtaagacaactatcgatgaggcttgggcgggagatattatcggtttaccggataacggaacgtttaaaattggcgatacgcttaccgaaggcgaacagcttcatttccgtggtttaccgagtttttcaccggagatgttcaagtatattgagaatgccgatccgatgaagcagaaacagcttgccaagggcatcgaccagttgatggacgaaggtgtggcccagttgtttgtcaaccagttcaatggccgcaagattatcggtacagtggggcaattgcagtttgaggtcattcagtatcgtttgttgaacgaatacaatgcttcttgtcgctgggagccattaagtctgtacaaagcatgctggattgaaagtgatgatctggaagaactggaagcattcaaaaagcgtaaatatcagtatatggccaaagaccgcgaagggcgtgatgtctttctggccgattcgaattatgtgcttcagatggcacagatggatttcaaaaatattaggttccactttacgagcgagttctgattcgctttacgaaataaattggattaagacggtgggcgggttgcagaacagtgcaatttgtccaccgtttgttctctttctgacaatataaaaacaccttgttaacgcattcttatggtataattttccctaaataaggggcgatgttgccttaaaaattttacctttgtaatctaaacaaaaactcgaagtcatgaagtataaattgttagtccttgatgtagacgggacattgcttaatgatgaaaaggagattactccacgtaccctcgctaccttattgaaagtgcagcagatgggtgtacatcttgttttagcatcgggcaggcctacctatgggattttgccattggctaaaaaactggaattgggtaactatggcggatatatcgtgtcttataacggtgcgcaggttattaatgcaaaaaatggagaagtattgcttgagcggcgtattaatccggaaatgttgccctatttggagaaaaaggcacgtaaaaacggattttctatctttacatacaccgaagatcggatgattgccgattatgctaataatgaacatattctttgggaagcacgtctcaatgggatggagctgattgaggaacccgaattttcggcagctgtagattttgctccttccaaatgtatgttggtcagtgatgatgaagaagcattggtagctttggaagaacattggaagaaacgtttgaacggtgcactcgatgtattccgttcggaaccttattttcttgaagtgttgccttgcggtatcgataagtctacctctttgggagcactgttgtcccaccttgatattacacccgaagaaacgattgtgataggcgacggtgtctgcgatgtttcgatgatacagtttgccggattgggtattgccatggggaatgcccaggattctgtgaaagtttgtgccgatgtggtgactgcatcgaacgaagaagacggagttgcccttgccgtagaaaaggcgattcttgcagagatccgtcctgccgagattccacttgatcagttaaacgagcgtgcccgtcacgcattgatggggaatctgggtattcaatatacttatgcgtccgaggaccgggttgaggctaccatgccggtggacgaacgaacccgacagccttttggcattctgcatggaggggctactctggcattggccgaaactgtagccggattggggtcgatgattctttgccagcctgacgagattgtcgttggtatgcaagtcagcggtaatcacatgtcatctgcccacgaaggagacacagtgcgggctatcggcaccatcatccataaaggtcgttcatctcatgtctggaatgtggacgtatttacgtcgaccgacaagttggtgtcttctattcgggtggtgaatagtatattaaagaagagatgacgtcagaagaaacaaataattgtgaaattatagatgagttgatccggcagggaagaagttttgcgatgtatcgcaatccgggggaagaagaacctcactttctgatgcagacttacggagaagtacgtttggttcgggaaatggaagaactaaacggacagacaggttttgttatcgctcctttccgggttactccgcaatgtcctatcatactgattcaaccggactgtcaagaaattccttcctgtgcaggcagcccgcgcaggagtgtgcagcctgtctgcacagaggtgtgcagacaggctgcacaaaacgaacggcctgtgagagcaaaggaagcttatgcagcctgttttgatatttttatccgggctttacgggcacatactttcgataagctggtgctgtcccgcaaagtgacggtgaagaaagaaccggggttctctcctgcaagcgctttctataaagcttgcaggcgttatatttactcctatgtctatctttgctatactccgcaaacgggagtgtggatgggcagtacaccggaaatcattttatcgggtgagaagggagagtggaatactgtggcattggccggaacccagtctttacaaaatggtgaacttcctcagcattgggatgagaagaaccgggaggaacaggaatatgtagccgcatatatccgtaatcaactccgatcgttaggtatttctccggtggagaagggaccttatccggcttttgccggagctttatcgcatctgaaaaccgatttccgtttctcactgaacgatagtcgtaaattgggggatttgttgaagctattgcatcctactccggctgtgtgcggattacccaaggaggaagcctatcggtttattctcgataatgaaggctatgaccgcagttattattccggatttatcggctggctcaaaccggaggggaagacagacctgtatgtcaacctacgctgtatgaatgtgaaagaggatactctgacactttatgccggaggtgggttactggcatcttccgaattggatgatgaatttcaagagactgaaaagaagatgcagacgatgaagaacttgaactctttataaataacttaatagagcgatgtattcagataaggaaaacatattgcagttggtagcgttgcttcgggcacacggagtgacgaaagtggtcttatgccccggaagccggaatgctccgattgtacacacacttgccggacatcctgatttcacctgttattcggtaacagacgagcggagtgccggtttttttgctatcgggcttgccttacatggcggaaaacctgcggcagtctgttgcacatccggtacggctctgctgaatttgcatcctgccgtggcggaagcctattatcagaaagtacctttagtagttatttctgccgatcgtcccgcagcctggattaaccagatggatgggcagactttaccgcaaccgggtgtctttcagtcgttggtgaagatgtctgcgaacttgcctgagatacataccgacgaagacaaatggtattgtaaccgtttgctgaacgaagcattacttgaactgaatcaccatggcaaaggacctgtgcatattaatgtaccggtttcggagcctttgttccagtttacggcagatgttcttcccgaagagcgtgttataacacgttatcagggactgaatgtttatgatcgcgattacgacggtctgattgatcggcttaataaatacaaccggcgcatgataattgtcggacagatgaatctgatttacctgtttgagaagaaatattcaaagatgctgtataagcagtttgcttggtttaccgaacatttgggtaaccagactgttcccggtattccgatccggaattttgatgctgctttatatgccatgtctccggaaatgcaggaaaagatgatgcccgaactggtaatcacttatggaggacatatcgtctccaagcggatgaaaaaattccttcgtcaacatccgcccaaggagcattggcatgtgtcgacggatggtgaagtgattgatctgttccaaggttcactcacgacggtcattgaaatggacccgtttgagttccttgagaaaatagctttcttgctggacaaccgtacaccagagtatcctcggcaatgggaaaatttttgcaaagaacttccccaaccagagttgccctattcggagatgtctgccataggagcgttgataaaggctttgcctgcttcatgtgctttacacctggccaatagttcggttgtacgctatgctcaactataccctttacccgatacaatagaggtttgctgtaaccgtggaacaagtggtatcgaaggttccttatcgacagcagtcggttatgccgctgcctccggaaagttgaattttgtggtcattggggacctgagttttttctatgacatgaatgcgttgtggaataatcatttcggaagtaatctccgcatacttctcttaaataatgggggaggagaaatctttcatactctgcccggcttggaaatgtccggcacttcgcatcgttttgtgactgccgtacacaagacgtctgctaaagggtgggctgaagaacgtggcttcctttaccaggaagtgcaggatgaaaatcagctggacgaagcaatgaaggttttcacccaagccgagttattgactcagcctgtgttaatggaagttttcacaaacaagaataaagatgcacgtattttgaaagactattatcatcaactaaaaaaataagattatgattaagcaaggggtgatgttgattggtggcttattgctgtttgttataagcccacttgtggagaaggttggggccatgtctcccgggaataccgtattacaggaggtgacggctcatgtagatacaatcgattttaggttggcctctgccgaagaagctaaacgcctgatagtggttgaggatcattatacgcgtaactggactccgtttgatattgcagcccgtcttgagaatcccgaaggaaaaagagaagatctcgtcagtctggctattggtgaagttcgtgaatggactccccgggaggcgcaacagattgaacggatcagaaaaagcctgaatgacacgattcgtaagtatggttaccggattcctttcccgaaagaaatagtattggtaaaaacaacaatgaaagatgaaggaggagccggagggtatactcgcagtaactggatagcactgactgacgttacttttcagcggggaaacgagcagtcgcatactcgtctgttggtgcatgaaatttttcatatcctgacacgtttcaatcccggattcaaaaagaaaatgtacgaggctattgaatttaatattctgtcaaaagagattgaattgcccgaagatatccgggaataccggatttccaatcccgatgtcagccgttgggacagctatgccacttttacaatcgatggtaaacctcagaattgtaccatgattatatatgccaacaggccctatactgttggtaagttctatcagtatatcaatgtcggtttgattcctttggataaagcattcaaaccagttcgggaaaatggcaagacggttatttatccgttgcagaaagctgccgacttttttgataaggttgggcggaataccggatatgttatcgatccggaagaggtgatggcagataatttcgctatcgcaatgttgaacaaccccaatgtaaagacacccggactccagaagaaagtacaggaattattaaagaaataaccattaaaatgaataaagatggaaacgaaaagagagtggactcctattaaagaatatgaagatattctatttgattactataatggcattgctcgtattacaattaaccgcgagcgttatcgcaacgctttcacaccgaccacaaccggtgagatgagtgatgctttgcgtatttgtcgtgaagagcctgacattaatgtcgtggtactgaccggtgccggtgacaaagctttctgctcgggaggtgaccagaatgtaaaaggacgaggcggatacatcggtaaagacggggtgccccgtctgagtgtgttggacgtacagaaacaaatccgttcgatacctaaaccggttattgccgctgtcaacggatttgctatcggtggcggacatgtactgcacgtagtatgtgatctttccattgcctccgagaatgcaatcttcggccagaccggaccgcgtgtaggtagctttgatgcaggattcggctcttcttatcttgcccgtgtggtgggacaaaaaaaagctcgtgaaatttggttcctttgccgcaagtataatgctcaggaagctttggatatgggacttgtcaacaaggtggtgcctttggaaaaactggaagacgagtatgtccaatgggccgaagagatgatgcagctcagtccattggcgctccgcatgattaaagccggcttgaatgccgaacttgacgggcaggcaggtattcaagagttagccggtgacgcgactctgctttattatcttaccgatgaagcacaggagggcaagaatgcattccttgaaaagcgcaaaccagattttaagcaatatcctaagttcccataagtaaaaaaggccttcttgatgggaggcctttgctttatagtattcctatgtatacaataaatattatgccccgtatcctccatttcaagcagccggcaggaacttcccgcggtacctatactacccggaaggtttggtatatctatctttctacgacagagtattcggaacgtgtcggagtgggagagtgtgctccgttgcctaaactgagttgtgacgacctgccggattatgaacaaatactctgcaatgcttgccggtgtttggagcagacaggcgaactggatacggaagctttgcgtgattatccttcgattctgtttggacttgaaacagctcttcgtcattatgaaactcagagttgggcattatgggatactcctttttcccggggagaaaccggtatacccatcaacggacttatctggatgggcgattttgataggatgttgcaacagatcgaagtaaagatgcagtcaggataccgttgcatcaaactgaaaataggtgcgataaacttcgaagaagaattggcactgctgaagcatatccgtgctcattattcggcgagggaaatagagttgagagtggatgccaatggtgctttttcacccattgacgctatggaaaaactgaataggttggctgaattggaactacactccatcgaacagcccatccgtgccgggcagtgggaggaaatggcccgcctgacggcagacactccgcttcccattgcattggacgaagaactgattggctgtaatactcccgaaggaaaacaagatttattgacgtctgtccgtcctcaatacattatattgaaaccatctttacatggtggaatcagtggtggtaatgaatggattgcagaagcggaaaagcagcatatcggttggtggattacctctgcactggaatcgaacatcggactgaatgctattgcacaatggtgtgctactttccgtaatccgctgcctcagggattgggaaccggactgttgtttacagacaatatcgaaatgccccttgagattcgaaaagattgtttatggttttgtaaataaaagaaatacttatgatatttaatcgggaagaacaacagctgatgctggaaggcaatttgctttcccaggaagatgtaaaaagacttgttgccagttgtacagacgcaacgccggtatttctgtgtgaactctaccgttttctggacgattggttcaacgattctccttatcttactgtaaagacgtccggttctaccggaacacctaaacaaatgaaggtccttaaagaccggatgatgcagagtgcccggttgacttgtgagtatctggggcttcggcggggggatagtgcgctattgtgtatgcctttgcaatacattgccggaaagatggttgtggtgcgggctttggttgccgggctgaatctggttgtccgcactccttccggtcatccgatggcggatttggatcagccgttacgtttctcggcaatggttccgctgcaggtttacaatactttgcagatagccgcagaaagagaaaggctctgccggaccgatattcttataattggcggtggtgcgatagatgccggtctggaagctgagatacgtcaattaccgggtaaggtgtattctacgtacggcatgacggaaaccctgtcgcatattgctttaagacggctgaacggaccggatgcgagtactctttattatccttttccttcggtacgactttctttgtcacccgagcatacattgattattgatgctccgctggtttgcgatacgattttggtgacaaatgatgtggcggaaataaattcggacggtagcttttctatcctgggcagaaaagacaataccatcaacaccggaggtatcaaagtgcaggcggagcaggtggaagatatactgcgtccttggatacatgttccctttgccatcacttccgtttccgatgccgcattaggggaggccgttgttcttttgatagaaaatggagggtatacggaacggttggaggagaagatgaaagagcttcttaccaagtaccagttgcctaaaatggttttttcagtgggcactatacccttgacggaaacagggaaaataaatcgtgccggttgccggcaattagctgctacttatcaggtggggcgttaagtgttttttctttttcagttgtatcatatacggaatggctttaaatttaataaccaacacatataaactaatgaataagatttacttttttatcggagcttttattaccctgcttctggcgggttgcagttccagtccgatttcacatgtccgtttggctaccttcaacatccgttacgataatccgggcgatagcctgaattcttggaaataccgtaaagaccgggtttgtgagtttatccgtgaaaaacaaccggatgtactgggcatgcaggaggtgttacatcatcagttagaagacttgttggccggactgcccgattatgcctatgtaggcgtgggacgtgaggatggaaaaactcaaggtgaatatgctccggttttctatcggaaagataaatatgacttactggacagcaatacattctggttgtccgaacatccggatagtgtcggtaaacttggttgggatgctgcctgtacccgtgttgccacctgggctaaactgaaggagaaatccaccggaaaagaattcctgatggtaaatactcattttgatcacgtagggacagaagcccggaggaacagtgcattgcttattattgataagataaaagagatagccggtacacacccctctatgatgaccggagactttaatgtttctgaggaatgggaagcttataaaacaattacatccaatgagttcgtattgaaagatgcgtggaagatagctgcgaaacagacaggagaaagctatactttccatgattttggaagggtaccggtggctgagcgggagaagattgattttattttcgtaactccgcaaataaaggtggcggatgcggaaattatttcttccgcgattacagactctacctatttgtctgatcacaacgcacatttggccgacctggaattctaaaccacataaacagattacatgaccatgaaacaaaacttgcatttgttatttgtcgcttttatactgatgagtttttatagttgtactccgaagactgagttatcctctccggacggacacatcaaggtggcttttgcaacagaacctgacggaaagatggtttatcgggtggcggtcaatgatactcttttgttggacaactcatcgcttggtttcgaggcgaaagacgggatcgaccttaatcaaggatttcgtgtcgtgaaaactacgtttacagataaagatgaaacctggacccaaccgtggggagagaataaaacgaacaggaatcattataatgaaatggcggttttcttgaagaacgatgccaatatagagttaactcttcgttttcgtgcatttgatgacggtatagcttttcgttatgaatatgaggtgcccggcgttgactctttgctcgtcaccgacgaattgactgctttccgctttcacgaagatggaatttcctggtcaattccggccagcttcgaaacctatgaattgttgtattcggaacagaagatcagtgaagtgaagaatgccaatactcctttcactttcaaaactcccggtgggatatatggcagcattcatgaagctgctctttatgattttccggagatgacactaaagcaggatggaggccatgctctaaagtcggaacttgcttcctggcccgatggtatcaaggctcgtaaagggaataatttcatgacatcatggcgtaccattcagattgctccggcagctgtcggcctgattaattcatccttgattctgaatttgaatgaaccttgtaaactggaaactaccgactggattaaaccgattaaatatgttggcgtttggtggggaatgcatctgggggtagaaacctggaagatggatgaccgtcacggagccacaaccgctaatgcgaaaaagcatatcgattttgctcatgacaataatatcgaaggagtattattcgaggggtggaacgaaggctgggagagctggggtggtatgcagaattttgattttaccaaaccgtacgctgattttgatattgatgaaatagtccgttatgcacgtgagaaaaatgttcagatcatcggacatcatgaaaccggaggaaatattcccaactacgaacgccagatggaaaaagcgatcaagtggtataccgaaaaaggtattcatatactgaaaaccggttatgcgggtgcttttcccgacggacattcgcgtcacggacaatacggagtcaatcattaccaaaaggtagttgaaacggctgctcgttaccatatgactttggatgcgcacgagcctatcaaagatacgggaatacgccgtacctggcccaatatgatgactcgtgaaggtgcccgtgggatggagtggaatgcctggagtgagggaaatcctccttcccatcacgagatgctaccgtttacccgtttactgggtggcccgatggattatactccgggtactttcgacatattgtttacacagacgaaagattctcctaaacgtcagaagtggaatgaccaggataaaggcaatagccgtgtcaatacgacactggccaaacagttggcaaattgggttatcttatactccccgttacagatggcttctgatatgatcgagcattatgaaggacatcccgctttccagttctttcgtgatttcgatccggactgtgatgaatcaaaagcattggccggtgagccgggagaatttgtagtgatagtgcgcaaggctaaacagaattatttcctgggagcctctacgaatgaggaaccacggactttaccggtcagccttgattttctggaaaaggggaagacttataaagcaatagtctatgctgatggcgagcaggctgactggaaaaccaatccgaccgaatatcagattacggaacaggaggtgacggcaagagacacaataaatatccgcatggccgccggtggtgggcaagccatctcatttatgcccttgcagaaatagaaacagcatgataagagggaggtagtccttcaattccgaacgcaatattttcagggcttgccctatgcgataattgacagtttgcggagagacgtttagtttctccgcaatttctttatgagtcagttgttgatttcggttcatttcatatgcctgacgaaattctgccggtagctttcttaaagcctcttcatacaacctgaaaagttcgttttccagataaaagtcaggtgaagaaaattcgctttcatatttttcggcaatttccagatgtactttacgctttatttcgaaatgggagattttattaagtgccttgttcttgacaatagtaaaaagaagagtttttaaggttagttccggaatgagggtttttctgttttcccataaccacatcatggtgtcctgcacgatttcttccgattcactcagtgtgacgtactgagaacaaaagatgcatagtccgcgaaagtaatggcggtaaacattgtcaaatacttcttcgcacccttctctcaaggctgatataacggcattattatcatttatgtttaggttagtcagagtctgtgccattctttttttcattgttattagcgaacaaacgtagctaaattttcggtactgacaaaatgattcttcgaagaaaaaaagtttgtgtttttatttagtaactttgctttctgaaatgtattatacataacaacgtatgatataggtataaaagatttggttaatacaatggatgaaacaaaactactgaactacttgaaaggagagtcagatgctgaagagtgtctggaagtagagacatggtaccatgactctgcggaacataaaaaacaacttgaacaactatattatatgctttttgtcggtgagcgcaaagcggtgatagatgcggtggataccgaaagttcactgagcgctttgaaggatcggatgaagcagaaagagccggatagaaaatcggtgggtaaaatgcgtgtttcaaaatggaagcgttatgcagtacctttggctgcctttttgtgcggtttactgatttctaccggagctttgtattggatgtcttccggcaagtctgccggatatgtttttgctacggaagccggtcaacgggcacatgctgttttgccggatggcacgaaggtgtggttgaatgcttcaacgcagcttgtttataaaccttctttctggaagcgggaaagattggttgatttgaatggtgaggcttattttgaggtctctcataataagcacaaaccctttgttgttaatagtaaagatgtcaggacttgtgtgctcggtacaaaattcaatgtccgggcacgctcgtccgaagcaaaggttgtgacgactttattgaaaggattggtgcaagtgcagctgccgggacagtccgaagaagaagggatcttactgaaaccgggacaaacgttgagtgtggatacccgtacgatgcagttgatgcttaccgaagctgatcgtccgggtgatgtgttgctttggattaacggaaaactgaaattcgaacaagctacactcgtggagattgtgcaatgtctggaaaagcattttgatgtacatttcattatttctgatgcacagttgaaaaaagaacgtttcacctgtacttttagtacggatgatgatatcagacaaattctttctatacttgctcttaccaaacgttttgattataaatgtgaggataataacataatattgactcccaaggcgggtagatagcgatttattattataacctaaatcagtaaaagggactgtttccaatgtggaatggttccttttttttatttcttaatctgtattcttattctttttttattctttttttgaaaaaagtcgcctcttgatttagtatgcttataggttgaaatgtattattagcagaaaagtgaatatagttaaccctaaaatctgtaacgatgaacaaggacccttaattaaaaaccaaccttaatatgaattagcagttttcttttgctaaacctttcaatttttacctaaaacattttctaattaaaaaagaacaagatgaagaaatcagtgaaacacaagtttcagtacttgctattttttctattgtcgatgcctgcttttatttttgcttcagcgcaagatatccgggtaaatatcgacttcactaaagcccctttaggtaatgtcctggatgaaatcggacatcaaacctcattatctatcgtgtataacaccagggatgttaaccccaatcaacccgtttccgttaaagctactaatgaaaatattacgtctgtgatgaatcgtttgcttcgggggacggggatttcctattctattatgaacaaacacctcattctttcagctaatgataaggataaagctattcagcaggagaaaattacggttacgggaaatgtctcggacgctaaaggcgaaccattgatcggagtaagtatattggtgaaaggaacatccaacgggacaatcaccgatatgaacggacacttttcaatatcggctgccaaaggagatgtcatcgagatatcctatatcggctatgcttcgcaggtcattacagtgacagactctaagccactgaaaattgtgatgcaagaagacacggaagtgcttgacgaggttgttgtaacggctttaggtatcaagcgggcacaaaaggcattgagctacaatgtgcaacaagtgggtggcgatgccatcaatacagtgaaagatgccaatttcattaactctttgcagggcaaagttgccggagtaacgattaacaattccgccggtggtgtcggttcggcctccagggtagtgatgcgaggtactaagtctataacaaaggataacaatgccctttatgtaatcgacggtattccaatgttcaatgtcagttttggcaagagcgaaggttcctttgctactcagagtggttcggacggtgtggccgaccttaatccagatgatattgaaagtattaatatgctgaccggtccttccgcagctgctttatacggcaatgcggctgccaatggagttgtattgattaacacgaaaaagggatctgccgagaagacaactctgacagtcagcaataataccatgttctctgatgcgtatattatgccggagatgcaaaaccggtatggaaataatccgggagaatttgcaagctggggcaataaaaccagacagggttatgatcctgcccgtttctttaataccggagtgaatgtaattaatgccatctctttctcgaccggaacaaagaaaaaccagacttatgcatcggcttcaacaacgaatgcaaccggtatcctgcctaataacagttatagccgttacaacttctcaatccggaatacggctactttcctgaaagataaactgactctggacatcggtgccagttacatcatccagaatgataaaaatataacggcacagggacaatatttcaatccgttgccggcattatatctgtttcctcgtaatgataattttgaggagatccgtatgttcgaacgttatagcgagagccgtggggtgaatgcgcagttctggccttacgggcatcaggggctgagtttgcaaaacccgtactggattatgaaacgcatgaaccgtaaaacagaaaagaaacgttacatgatcaatgcaagcctgacttataaacttacggattggctgaacgttgcgggccgtgttaaagtagataattcggatattcgtttgactcaggagcgttatgcatctaccctgactacttttgcgggagccaatggtttctactcggaccagaaccgtacagaccgtaatacatatgctgatattatggtaaatatcgataagaggataggggatttctcgctgaatgccaatatcggtgcatctattaaagatttggtttacgaacaaatgggtaatgaaggcgatctggccggtatacccaatttctttacagtgagaaatattaattatgaaagtaattataagcccaaacagttcggatatcatgaccagtcccagggggtatttgcgaatatagaattaggttggcgcagcatggcatatctgaccttgaccggacggaacgactgggagtcgcagcttgcctttactaaacactcctctttcttctatccttccatcggcggatctgtcgttctgtcggagatgttccggttgcccgagttcatctcttatgcgaaactgcgtggttcatacagttcggtggcttcgtctttcgaacgttatttatcgaatccgggctttgagttcaatgaacagtcccatcagtggggctcttcaacaactttgcctgccactaatctgaagccggaagacacacgttcgtgggaggtgggtttaaatgccagattatggaaccacttcagtatagatgccacttactatcattcgaatacgtataaccaaacctttaacatcaccctggcgtcgtcgagcggttattcttcggctattgtacagacaggtaatatccagaattatggtttggaactggcattgggatataataatacatggagggatttcagctggaacagcagcctgacttataccatgaatcgtaataaggtgaaacgtctggccagtggcgcgacgaatccgataaccggtgaaatcatcgatatgccggagttgcgtatggctgtgttgggagccgacggatatggtcccagagtcatcctgagagaaggtggaacgatgggggatctgtatgtagataaagggcttcgtacggatggtaacggaaatatctgggtagatccccagacaggtaaagtcggagtgcaggactatgccgaacctaaaaaaataggtacgatgaatcctgatttcaatatgggattcagcaataccttctcttataaaggcgttagcttgggcgtggttctgaccgcgcgtgtcggtggattatgcgtgtcgaacactcagggtatactcgattattacggtgtgtccaaagctacagccgatgcacgtgatgccggcggagtgtggatcaataacggattcgtagatgccaagtcttattttcaaaccatcggaggctctaccggaggattgggacaatactacacttatagtgcgacgaacgtacgcctttccgagttgaacctgagttatacattacctcgtaagtggtttaacaataaagtgggcataacggcaggtatcgtaggaaagaatctttggatgatttattgtaaagcaccgttcgatccggaaatgaccccttctactaccagcaatttctatcagggggtagattactttatgcagccgagcacacgtaatattggcttcaatgttaagtttcaattttaaaacaagtctattatgaaaaataaaatattaaatatggctttggccgcagctatcacgccactcttgtgttgctgtaccagtaattttgaggaatacaacactaatccgtacgaaccccattcacttaatccgcccatgctgtttgcaacaatgattactaccggaatcaatgtacagcagaatgacaatcagatgattgaccagatggtagcgggaccttttagcggctatctgacaatggctaactcatggggtggttctaacttcaatacattcaaccagacggaatcctggaatcagattcctttcaatacgccttttgagaaattctattccaactactttaaattggaaacggcaaccggcggaaaaggtcactattgggcaatggcgaagctgcttcgcgtaaatacaatgttgcgtgtgaccgattgttacggccccattccctacagtcaagtggccaatggcaaaacggctgttgcatacgacagtcaggaggatgtatataaacacatgtttgaagacttggattatgcagtacagatattgggcgaatttgtagacgaggtcggcggattgaagccgttggagggctatgatccggtctataatggagattataataagtggatgcgttttgctaattcgcttaaattgcgtctggctgtccgtatcagtaatgtggcgcccgaacttgcccgtgcgaaagctgaggaagcggtaaagagtgcccgcggactgatagatacgaatgataataatgcatatgtcggtgtaggtgccgaacccaatccgctgtggctggtagcctccagttggggcgaaatccgtatcaatgccactattgccagttatatgaaagggtattccgatcctcgtagcgcagtctatttcacgacatccaagttgggaggcaatagcccgtatatgggtatgcgttcgggattggaaggagtgaagccggccacttatgcaggatactctatgcccaattacgatcagaaagacgatatgttgatgttctgtgcggctgaaacagcctttttgcgtgctgaaggtgctctgcgtggttgggatatgggaggtagtgcccgtgacttctacgaacaaggcgttaaactttcattcgaccagcggaaagtgggtggagcagaagaatatctggcaaatgcagtggcagtgcctgaaccttttgtcgacccgactaacccggttaaatgcaattatacaccgaaaaccaagataacgattgcgtggaatgaaggtgctcctacggaagaaaaactggagcgtatcattactcagaaatggatagccaatttccctctgggctttgaaggttgggccgattatcggcgtacaggttatccggaagtgtttccatctgtcagcaatctgagtaacggagtaattgacaccaaccggcaattgcgacgtttgcctttcccattgtccgagaagcagggaaatgctgccaatgtttcggtagccgtctcaatgttggggggcccggatactggggctaccgacctttggtgggctaaaaagaattgatgtttaagctaaaaagagaaaagaaaatgaaaaagagatatttaaatatagtggtttttgcgttgttcgtcagtatgcttctgggttgcagtgactggaccaaacccgaggcagaggatttttttgaaatgccgggaaatgactactacgagaatctgagagcttataaacgttcggagcattcggttgcgtttggctggtttggaggctggacaggtgtgggagcttcgatggtggggagtctgatgggacttcccgatagtgtggacttcgtttccatctggggaaactggaagaatctggatgaagcccggatgctggataagaaaaaagtgaaagaactgaaaggtacgcgtgcattgatgtgctttatcgtagctaatgtaggcgatcagttgacccccgaagagtataaagagaattataaagaatattgggggtggaaagatggcgatcaggaagctatcgacggcgcgatcagaaaatatgcaaatgccatttgtgactccatcgataagtatggatatgatggtttcgatatcgattatgaacctaattatgggtctcccggaaatctggccagctatcccgaaaatatgctcactttcgtaaaggcgttaggagagagaatcggacccaaatcgggcacggggcgactgcttgtgatcgatggtgagccacaaagcattcatccggaaaccggaccttattttgattacttcatcgtgcaggcatactccaaccttgcgggtaactccgatactaatcttgacaggcggctggccggtacaattgccaattttaaagaggtactcactcccgaaaaagtggctaatatgtacatcgtcacagaaaatttcgaatcctatgctccgacaggaggaggcgattatgtagatcgttacggaaataaaatgcgggcacttgccggaatggcacgctggactccggtcattgatggtaaacaagttcgaaagggcggagtagggacgtatcatatggaatatgattatccgggcgacgttgaatacaaatacttgcgtgaggcaatcagaattatgaatcccgctgtaaaatgacttaaatgaatttgattatgaaaagaataacaataaaatcttatttgcttgcttgtgttgttctgccgatgattctggctggatgcgaagatgccgattaccgtgtgattgacaatgctatttatctgaatgaagcatccgagaatggttcggcaaaggttacggttgatcctgaaaatgttaccacaactactttgaccgtacgcatggggcagcctgttgccggagatgtaactgctgttttgacgattgacccctctattcttaaagagtacaatgaagccaatgaaacttcgtacgaggttcttcctgaacaatatttttcttatgataaagagataaagattcaggcgggtgatgtaagtgccgtaccatcagaatttaaggtgaaaccttattcgaatgaaaacggagaactctatgccattccggtatccctcaccgaaattcaaggaccggtgtctacgatcgggctttcgtcgaagtttattattttactggacaagccgctgatacagtccgtgccgtttatgaatacaacaaatgctgtaaaaccgtccaaagaaggtttgtggggagtgacaaccaacgaatggtcgcttgaagcctgggtacaaatggatggctttgacattaataatcaggctatcttcaattcgggtagcaaagaccatgaggtatatatccgttttggtgacgctatgattccttataattcattgcaggtgaaaacgctgggaagtcaggttaatacggtgactttgtttgagaaagacaaatggtatcatctggcgttcgtctataattcttccggattgttatcgatttatattaacggggtgcttgatgtgactttacaaacgaaaggaggcccggtacggttcgacacgatgaacatggtttcaagcggcagctacttccggaacaattgccagatggctcaggtacgtctttggaagacagcgatcagccagacacaaattcagtctaacatgtattttgccgtgaaacccgctgatccgaacctgataggctactggaaaatggacgagggcaaaggaaatgcttttgccgattgtaccggacacggatacgacctcacggcaggaggaactcttgtatggaaagagcatgttcgttttgataaacaataactatgtaaaagaagaataagatatgaatagacatttgaattttgtgaccttaatctgtttgataacagggtttgtatcattggcttcgtgtagtaacgatgatgatgaaatgaacaaatatcaaaaaatatatatcagaacgggagtagcaccgggggctgaaatgagtgctgtagtagtggtagatcgcgtaagtaattcatctaccgctgaccgttctgattttgaaatacaactgtgtgccgtacaacccgtttcacgggaggtcaccgctactttaggtatcgataccctgaaagtaaatgcttataattcggctaaaaagacgaaatgcgagttattgcccggagataattatgacattgagaaaaaagagtccactctgaaaaccggacagactgtcgccgagtcttctttccgtgtggttttgaagaacatagagaaattgagcaaccctgacggatacgtactcccagtgatgcttaaagaagttaccggtatggacggacaggctgtaagtacatctatgaatacggtctatatccggatttatgccagcatactctataccggctatacgaagcctgcagactgggcggcagtggaccgcagtgcatgggatgtaagttgcagtaatgcatacgcaaacgatgatgccagatatggtgcacatctggctatcgatggtgaagcaaatacatcttggttttcgtggggagtagccaatgctggagagtgctggtggaatacagtattgccccggcctgttactttggcaggattttcggttactaaacagagtgcttacggatcgtcatacaatctgaaaagtgcggagatcaaagtcaggaaagacggagcgacagaatgggtgacttatcagaggactttgactttcaggagctttaaaggaaacgagccgcagtatgcagtcatcgaaccacctatcggggatgttaaagagttcaggattaattgtctgagcccggatagctataccggatttgcggaaataaatttatttgtgaagcaatagaggtgtttagattgtagataagggggagaagcatcggggccatggggtttcggtgcttcttttgtgtacttcatcccgacagagcaaaaaaaagaaccggtaaggattagtgattttgtgaagtcagttgtattattatgtagtgaatgcaacttcttgtcgtaattttgggctatgtttttaatatcccctatctttgcttactggaattgttaaccgatggaattattataaaaaactaactgatgaataaaaagccgataagccctgtatgttgggtgcctactgtttactttgcgatgggattgccgtttgtggccctttcgatggtttctgtccttatgttttccgatatggaggtgtcgaatgcacagattgctttctggacttctctcattatgcttccctggacattgaagcctttatggagtccgtttctggagatgtttaagacgaagaagtactttgttgtcgctacagaaatcattaccggactggcatttgcgttggtggcactttcgctgccgttgcccgatttttttcgttatgccatcgctctgatggggatcattgctctcagtggtgcgactcatgacattgcgggtgacggagtatacctgacggagctgactgctacccagcaagccaagtatatcggttggcagggagctttttataatctggccaagatacttgccaacggaggcttggtttggctggcaggtatgctgaaggatgaatttggagtggtacatgcctggatgattgtgatgttgatgtgtgcgggtattatgattttgatcggcctttaccacattcggattctgccttcgggaggaggtgcttccggtgaagtaaatacggtgagagatgcattgaacgtgctttgggaagttattcgttcttttttccaaaaaaaacatattgctttctacattgtctttatcattttgtaccgatttgccgaaggatacgctctgaagattgtaccgttgttcctgaaagcaccggttgcagatggcggattggggcttagtactcaggacatcggattggtatacggtacgttcggagcaggagcatttatcctcggttcgctcttggcgggttattacatctcggcttacggacttcggaagaccttgttttctttgtgttgcgcttttaatattccgtttttggtatacttcctgttggcactttaccaaccctctaacctgttgattatcggtacggccattgtatttgaatatttggggtacggatttggtttcgtcggattaatgctctttatgatgcagcaagtagcccccggcaaacaccagatggcacattatgcttttgccaccggtatcatgaatttaggagtaatgcttccggggatgatgagcggatatctgagcgactggctgggttatcgtgatttctttgtctgggtgctgatcgctaccataccggcttttgtcgtcacttggctggtaccttttacgtatccggacggaaagaagaaataaaagagaatttcaatataaatgagatatatacataatattaatttaatcgaatcatggaagaatttaaaattgcaggtgctgctttgccggccatgccttgggaagaacgtccggcaggatgcaaagatgtagtgtggcgttgttcggcaaatccgattattccgcgcgacttgctccctacttcaaacagtatattcaacagtgccgtagttccgtttaaggatggctatgcaggagtgttccgttgtgatgataccaaccgtcgcatgcgtctgcatgtggggttcagtaaagatgccgttcattgggacatcaatgaagagccgttgaagtttcaatgtgacgatgcggagatcgggaactgggtttatggatatgatcccagggtttgctttattgaggaccgctattatgtgacttggtgcaacggttatcatggtcctactattggtgttgcttatacctatgactttgtaacgttccatcagctggaaaacgcctttattccttttaaccggaatggagttttgtttcctcgtaagataaacggccgttttgccatgttgagtcgtccgagcgacaatggacatactcctttcggagatattttttatagtgaatctcccgatatggaattttggggacgccatcgtcatgtaatgtctccggctccgtttgaagacagtgcctggcagtgcaccaagatcggtgcaggacctattccgattgaaacatcagaaggctggttgctgatctatcacggtgtattagcttcatgcaatggttttgtgtatagtttcggttccgcattgcttgaccttgatgaaccctggaaagtgaaattccgttcgggaccttacttgatttcaccccagaaagagtacgaatgtatgggcgatgtgcctaatgtctgcttcccgtgcgcggcgcttcatgattcggagaccggacgaattgccatctattacggatgtgcagatacggtgacgggacttgcattcggatatattccggaaattatagaatttacaaaacgtacaagtatcatctgaatcggataaaagagaaagggtgtagctatcctgccgggatggctacacccttttgtctgtatggctacaccctttagataaaagggcgtaaccctgtttggagttatccgttgtatgctgtcagcatccaaaccattttttcctgttccttcagatagtcgctcatcatagccactgttacctcatcgttgtgtgaagaggcgagagacaggactttacgctcttctgctatcaggtgcccgtaagtttcaagaatatgattcaacgcgtcatcggctttgctcactccgtccacttccttgatttgtgccatcttcaggtagtcactgtacttattggcgggagttcctcccagcatcaatatgcgttcggctatttcgtccaccttttcggcagctccgttatagaggtcttcgaatttaccgtgcagtacgaagaaaccgtgtcctttgatattccaatgaaatcctcttaagtttgcatagtgaatttgaaaatcggcaagtaattgctgcaatgatactacgatgttgttagctcccttttcatccaaatgtgtataatttaaagttttcataatgctattgtttttttgagttaatactatatatcttctttttatctggaacaaagatacggcacaaaatgattcgtgtcaaactgaaaatttctatctttgcattgatagattctatatctttaataaatcagagaacgatgactatacaacaattggaatatattctggccgtcgatcagttccggcactttgcaaaagctgccgagtattgccgggtgacgcaacctactttgagtgcgatgatccagaagctggaagacgaattgggagtgaagctgttcgaccgcagtatgactccggtctgtcccacttccatcggtaagaaggtgctggaacaggcacgcaaaatcctttcggaaactacctgcgtcaaggagattatcaatgaggaacagcattctttgtccggtacgttccggctggccgtattgcctacgattgcaccttatcttttgcctcgtttttttccgcaactgatggagaaataccccgatcttgatatacgggttatggaaatgaaaacaccggatatccgcaaggctttgctgacgggtgaagcagatgccgctatcattgccagcctgctggatgatgctgcattaacagaggagactttgttttatgagcagttcttcggttacgtttcgaaaaaggaaccattgttcaaacacgatgtgattcgtacgtccgacgtgaccggagagcggctttggcttcttgacgaaggacattgctttcgcgatcagttggtccgtttctgccagatggaagcggtaaaggtcagccaaatggcttatcgcttgggcagtatggagacttttatgcatatggtggagagcggtaagggcattacatttattccggagctggcagtgatgcaactgagcgaagaacagaaggagctggtccgtccgtttgccatcccaaggcccactcgccagattgtcctggttacacgaaaagactttatccgtaccagcctgctgcaagtattgaaagaagagatccaggcagcagtccccaaagagatgcttactttacaggctgttcagtgtctggtataaaaaaacagcggcgatattttcacaaacatcgccgctttatttcttttatatatcagaattattcttagttttgtcaaatttgtgcaggtgtcttctgttgttttattgagaatgaaatgattttatttttaagttcttatcttcattgatatctattgtgatatactgtatgttgtcataaatcgtgtttacacggagctttattccttttgctgtcggcaacagatcggctatattggccagtttgaaggagacgaggcttgaacccagtttactgggagagtcgtcaaaggcgttatgcctgaattccagacagatatatccgtcgtcttcaacaggacctgtaattttgttttgtaccagattcagcatgtgctttttattctcgtccatactgcccagatattggtattcgatggtgagataatcctttgtaagtgcatgcgccgtgacgttgatgcggtcgtctccaatgctgtccgccgttgcttccgtcagcgggatgatatcctttgtcagtatatcttctatcgtgaatatcttaccgttttcatatccgggcttttcttctccttccatcttcacgtaacccacaaaaaccctctgtccttctgcgacggtgtatttccagttgcgaatatcagccgtatctgcggggaatacgttatttccattgtccagggcaataaaaaaatccctcggggtgtccgcattgggaattttcattgtaccgatggccagtattccacccggaggacaagtgacccaataatcattgtcttcattgtccagacaagactgcaggatgggcattagtgccagaatgagggtaaaagtaactaatttaaatcttctcataagttcctgttggttttagtatcctatttattcattgagatttattcttcgctgtattgaagaaatgcggggagccgtgaaatattgcatcataaaatgttaaagaaacaaaagtgataaaagagttgttctctcagtgcagtatttctatctttgctgcatttataagataaacacgtgtttaggagaatgaatgaattagagctgtcggaacgttgcaggcagggagataatcgtgcccgcaaagaactttatgagcagtacgcagggcgcatgcttggtgtctgtcttcgttatgccggagacagagacatggcacaagacttggtacacgacggtttcctaaagattttcgactccttcgataagtttacctggcggggtgaaggctctctgagagcatggatggagcgtgtaatggtgaatacggctttacagttcttaagaaagaacgatgtgatgaaccaaaccatggcactggatggagttcccgaaacttatgacgaacccgatgcttcggctgtcgaagcgattcctcagaaagtgctgatgcaatttattaacgaactccccgccggatatcgtaccgtattcaacttatacacctttgaagataagtcgcacaaggaaatcgcacagatgttggggattaatgaaaaatcttcagcttcacaactttttcgggcaaagagtgtattagccaagaaagtaaaggaatggttgatgatcaacggttgacgtatgtcttcggacaccaagtgaacccgggatttctaaaatagaatagaatgatgaaagaaaacgaaaaatggataaaggcattcaaagagaagctcgaggattattccgagccgatacctgcttccggttgggaacgactggaaaaggagctgatgcccgtaaccgaaagacgaatatatccgtaccgccgatgggccgttgccgcggctgccgtagtgttggtggtgacgactgctgtaagtttgtatttcctgaatagtccggtcgcagatgaaattcgttatgcgacggctccttcattggctgtcaatccggatatattgccggaaccggctttaccggatgtacaggtcgccgtgtccgagccaatgaagccggcgggagggacagacgtgagttccgcttctggatatttggcgaaagggaatgatccaaagatcactccggaagcttttccggaggcagagaaacatccggaggctgtggtggcggagaagcctgccgaatcacagtctgaagcaactgctgtaacggagaaaaaagagagtactgcgtcacaaatagagaaaaggaaagaggcccggaggccatccggtaaagacaaataccagttgcctattgagagttcttctgcaaggcggaatggaaaatggtcgatgggagtaggggtaggcaatgggggaggacttccgacgaatggttcggaaagttttgcaccccgtccaatgagcaacagggtagacctaatgacaattatgaatggggccgtgaatattcccgcagatcaggaagttgtatttgaagggggagttccttatctgaagtccagtacgactaccgtgatggattatgaacatcatcagccggtaagtttcggattgtccgtacgtaaatcccttccgaaaggtttctccgtagaaaccggattgacttatacgttgttgtcttccgatgtcaagcgacagggagataacaagatgcagactcagaaactgcattatatcggtatcccggtacgcggaaactggaatttcctggaaaagaaatactttacgctttatgtatctgccggtggaatggttgagaaatgcgtatatggaaaactggcgggcgataaagtgaatgtgaaacctctgcaattttctgtagcaggtgcagtaggagctcagttcaatgcaacggagcatgtgggattttatgtggaaccgggagtttcgtatttctttgacgatggttcgaaaatacagactatccgaaaagaaacaccttgtaactttaatttgcaggcaggattgcggttcacttattaaagtaaggcagatgtaagccggagtggcggtggtgtttgaacagagtggcggtggcatctaatcggaatggcggtggctctctggagtgataaaaaaataaaggggatggggctgtgtcctctgtgttgaaaagactcttgatacactctcatccccttcttaatgataagctaatttacttgtactgtccggaagtattgcctgaataatttttcggccttttctatttgctccggagtgctttctttcactcctttcaagagatattctttgtccatcgcttcgtatttatgaactcctaaagtatgataaggcaatatctctacacgctgaatcatccggtacgttccaagatgttctcccaattgccggatatcgtcttcgaagtcgctgtagccgggcactaatacatagcgcagccagaatggcttttgattggcttcgagccaggcggcggttttcagtgtttgttcgttacttcttccggtcagagactggtggtgttccggattgaactctttgatatccaataaaaccaaatcagtcaaccccaagagttcttcaacatcattgttccacagtccgccgttggtgtcgaggcagatgtggattccagcttccttcagtcttttaaaaagtaggataagagctttcgcctgaaaagtgggttctccaccggagaaagttattcctcctttcttaccgaaaaaagctttttggctgacagccatgcggacaatttcatccggatgggttggcgtacctcctttggcttcgattgtgtccggattggcacaatacaggcaccggaagttacacccctgaaggaaaacgacgagccggagacccggcccgtcgaatgttcccattgactcgtatgagtgtacgtttatcattcaattacattctttcgtggaaacttcggctgataacttccagctggtgttcgcggctcagcttcacgaagttgacggcatatcctgaaacgcggatagtcagttgtggatacttttcgggatgttccattgcatcctgtagcatttcacggttcagtacgttcacgttcaggtggtgtgcgcctttggtgaagtatccgtccatcatggtcaccaggttgtcgatacgatcctcttgagttgcgcctaatgatttcggaacgatagagaatgtgttactgatgccatcctgtgaatcacggtagcgcaacttagctactgaactgagcgaagcaatcgcaccattcttgtcacgtccgtgcatggggttggcacccggtgcaaaggcgatgcctttggcacgcccgtcgggagtggcacctgttttcttgccatacatcacgttcgaagtgatggtcagcaacgagagggtaggacgggcattcttgtataccgggagtttcttcagttcttcgctgaagaagtataccaggtctacacccaagtggtctacacggtcatcatcgttaccgaagcaggggaaagcgccttcgatatcgaatccttcagtcaggccgatgtcattgcggcgcgctttcacatgcgcatatttgatggcagacagtgaatcgatagcgattgaaagtccggctacaccataagcaaggttaatgcgcggatcagtatctacgaaagccatctgagccttttcgtaataatacttatcgtgcatatagtggatgatgttcatagcctcgttatatacacgggcgatctgtaccaatacctttttatagttggccattacttcttcgaacttcagcgtttcgcctgtcaatacagggatgtcttttaccatgacagtgcctgtgttttcgcaacgtcctccgttgattgccagcaacaatgcttttgcaaggttggcacgggcaccgaagaactgaatttgctttccgatttcctggtaagaaacacaacaagcgataccgtaatcgtccgattggcggacctcacgcatcaagtcatcgttttcgtactgtacggatgaagtatcgatggatacttgtgcacagaatgccttgaaaccttccggcagttcaggactccatagtacagtcatgttaggttccggtgacggacctaagttgtagagtgtctgtaagaaacggaaagatgttttagtgacctttgtacgcccgtcgttgaaacgtcctccgatggattcggttacccatgtcgggtcacctgcaaaaatatcgttgtacgactgcatacgtaagtgacgtaccatacggagtttgataacgaactggtcgatcaactcctgagcgaatgtttccgtaatagttccctggctcagttcatattccagatagatatcgaggaatgaagacacgttacccaatgacatggcagcaccgtcctgctcttttacagcagccagataagccatgtacacccattgtacggcttcttgtgcggtatatgccgggcggctgagatccagaccgtagtattcacccaacaccttgatttctttcagtgccttgatctgttcggccacctcttcgcggaggcgaatgcgggcttctgtcatcggacctgtaagattatggaggtcctctttcttggcttcgatcagacggtcgagaccataaagggcaaggcggcgatagtcaccgatgatacgtccgcgtgcataattatcaggaagcccggtcaggaatcccaaagaacggaatgaacggatttcatcagtgtatacatcgaatactccgtcgttgtgtgtcttgcggtaatgagtgaagatatcctttactctatcatccacctctactccgttttcacggcaagccttcattactacattgattccgccgaacggtttgatggcacgtttcagtacctgatcggtttgtaatccgacgatcagttcgttctctttatcgatatagccggcagggtgggaggttatagtagatactgtagtgtaatcaagtgcgcgaattccattgttgtttctctcttcttcgagagctttgagacagttgttccagacagccttagtgcgttcagtaggtccttgcaggaaagaagcatccccttcgtaaggagtaatgttgttactgacgaaatctctgacgttgatttccttgctccaaagtccatctttaaaggtcttattcaattccataaaattaatcagttagtggttagttatcctttagagcgtgcaaatttacgatcttttttcggtttagggatataaaaggttcctattttatgttgaatagcataaaaatacctacttatagggaggttgtgttcctctctgttgaagtactctttcccacggctctttcatttaccccgccttcctctcatacaaaaaacacgtttcgatcttccatcttccaccttttagaatgcatgtcgttgattgtaagatgtatagattggtggaagatgcggtttttatgccatttatcttccacccccagggctcatcagcccgggtatgcgggctgggataaagagttgtatgacaatggttaatctactacacttctccggtaatagccagccggattctttcttaaaaaagaaacaacgaagcactgcttccgcatcgctgtgtgcgaatggaaggttttgcgggggggggggacaagggaggaaggcggttgttaaatgaaagagccgtgcctgcacctctactatcactctgctgtaaaacatccgtataaggataacaacataagcagaattttcttacattgtgccatgtttaacccttaatagagtaacgttatgattatcggagtacctaaggagattaagaacaacgagaaccgggtgggcatgacgccctcgggagttgccgaattagtgaaacgcggacatactgtatacatacagcacaccgcaggagagaacagtggttttccggacgaggcatatatagccgcaggagcgcagatcctgcccactatggaagagacgtatgccgcagcccagatgatagtgaaagtgaaagaacctatcgcaccggaatacaagctgatccgcaagggacagttgctgttcacttacttccattttgcctccgataaagaactgactcttgccatgatagaaaacggctcggtttgccttgcttacgaaacggtagaaaaagctgaccattctttacccttattgattcctatgagtgaggtagccggacgcatggctatataggaaggcgcccgtttcctggaaaagccgcaaggtggaaaaggtattctgctgggaggtgtaccgggtgtgaagcctgccaaagtattaattctcggcggaggcatcgtaggcagcaatgcagcccagatggcagccggactgggagcagatgtcacaattgcagatatcaacctggcccgtcttcgttatttgagtgaaacactgccaaaaaatgtaaaaaccttatatgcttcggaactgaggctgaagaaagagttgccggacgtagaccttgtaataggctcggtcttgattccgggagacaaggctccgcacctgatcacccgcagtatgctgaagatgatgcaaccgggtacagtattagtggatgtagctatcgaccagggaggatgtttcgaaacttcgcaccccactacccatagtgagccgacgtatgtggtcgatggaatcgtacattatgccgtagccaatattccgggagcagtgccttacacttctacattggcactgaccaatgccactctgccttatgtaacagcactggcaggaaaggggtggaaacaagcatgcaaagaagatccggcactggctttgggattgaatgtggtagaagggaaagtggtatataaagcaatagctgaggtattcgggcttaaatacgagcaattgaatttagaataacaagtaataccacggagtaacacagagtttcacgaagcagaatcataaaaagaagaactccgtaagactctgtgttaccctgtggtggaataatccgtttataacaaaaaagaagataccttgtccgaagctctgcggtatccctccaacaattctttcattacctcgtccacactttgcctgcggcggaacagagcagccacctgccctatctcaagctctccttcttccagatcaccttcgaagatgcctttcttggcgcgtcctctgcccaaaagttcacggagttcttcggcagaagctccccgcgcctcagccacttccaccttatcacggaacgaattggtcacaagacgggtaggcgccagtttcttcagcaataatttggtatcgccttcgttcaaccgcaaacaatattccttgaaaatatcacttgccgaactttcatccgtcaaagcaaaacgagtacctatctgaactccttcggcccctaatgccatcgtggcaaagatggcctcaccggtaccaatccctccggccgcaatcaaaggtaaagtagtggcttcacgtaccgcaggaatcagacaaagcgtcgttgtctcctcccgaccattatgcccgccggcttcaaaaccctcagctaccacggcatcgactcccgcctcttcgcatttcatggcaaacttagaagaagaaacgacatgtgccaccgtgatgtcacgctctttcagccagccggtccatgtcttcgggtttccggcagaggtaaatacgattttaaccccttcttccacaatgatattcatgatctcctctatctggggatacatcaaaggaatatttaccccaaaaggtctgtctgtggctgcacggcatttacgaatatgttcacgcaaaatatcgggatacatcgagccggagcctatcaaccccaaaccacccgcattactgacagccgaagcaagcctccagccactacaccacaccataccgccctgaataatgggatactgaataccgaaaagagaagaaattctgttcatagtcatatcgtttttgaaaaaagaaggcaagaatccccctatttatcttttaacaaattcaatgtataatcggttcaggaagcaacaccgttgtcgaatcaccatacgctttcagaacttccagtgtacgcgccctccgttcacgtccttttttgtcccagaaatcttttgtgaaaatagtcatcaggtcaagacctccgatagtgcctccactcacggttactccacttttgccaagcttcatggcagaggtatgcaccatgctctgcgtagtcaccatcctgccattggcacgttcgccaaacagattatgccgcaacccactggaacggatttcctcgtatgaactgcggatacctttatcgtatacatttttagcccagttggaaggaacggtctcataaaactcaacaaacggatctccccgccacgtatcggcatccacctgtatctttttttggtaaatagggtcccagttatatttggtattggccgtataaggccggagagtcaacacaattttctttctatcaagcacttgtggaagcgtctcgtccaatttcagaccgggcttctccttcgacattttgggagcacccggcaagctgttgaaatcaatctgtttcacagcatccatattcagcttgatatcctcttggccgttcaggatgcgttgcagattcaatgaatccttcgcagtccattgggcacgggctatcaggaccatcggacataaccatataaacaatatcaaacgcttcattcttctacacttatttaataagatgaaagtacctgcttcgcatgttcctgtctttgaattcctttacgtggctgttcatcgggcataaaggatcactgccgcccctgaagacagcaccagaaagtcgatacgtttcatctgatttagttttttaccaccaacggtatccactcccgcaaaggggctcgtcaaagcatgcgtcaatggtccatgccgtacgaggatactgcctgttttcccaccagcgacgataccgggcagcagcatcaagtaactcttcatcggtcaggaaatagatgccctcgtagttctcggcattggctctcaccattttgcagccaaacgacgcataatgccctaaccgaatggtttctacgatccacaacatgcactcgcccaaccggaccttaccgctatagtaagcagataccggcggaagcggaaaagaagcaacctgagtcaggtcttccgcataattcagcaatgccggaatatccttctccgtaaatttaggcacttctacaaagcccttcgggctcttggtattatagttccccgctttgagttgccttacgaaaaggtctacatccgggttattgtaatctaatgtctcttcgctgcaacttacacaagtaagcaatgataaaacaaccgtgagcagcataaaaaatgtttttttcataacgtccgtactaaatggttaataggtcatgcgcagaccgcaaatcaggttaaaattcgtaggccgtgccgaacgtactgtttccagcttggagtctgtcttgaaatggtgcgacactcccggttcggcaaataaagccagtttatcattaattttatagttcactcccactcctgcggtaagggccagttgcacaggctcctgtttgaagctgttatcgggtgctcccgctatgcacttatccgcaactccacctacagaagcatatatatccaacttcggcatttccgcaagtgtcacgttcagttttacgggaattcccagataatgcaagttctgtccggcacgcaaactggaatataataaaccggtttctacggctaaatgtttatttatttttttctctaccgtcagaccgaccgtaacaggcatcttatatttaccatctccggcaggcaatgcggtaccgactgccgcctttacagcccatgtccgggctttagcggtcatagccgtataatcggaagacggggattcatcagcagaatttactaaggtctgtccatctccgccggcctgccaatagtttttatccggatgactattttgtcctctgcgtgtagtcgttgcagagaagctgaatgacatggaaaccgtaaccgaaaccgaatcatcatcttcgtcctgatattgggccagagtaccgaaacgcttaggcgtcggtttactcaaaacaggctcggaatgtacgggagtgaaatcctgtttcaccacgtcaccatccaggtgagtcgcatttccactgacaaccgctacctgggtaaaggcttcttctatctcctctttcggagagaagaaccaaaaagcagccgatgaagcagccagtaccagcagtacggaagcggctgccgctacgcggaagaaaaacaccttccgacgatggcaacgcaccatcacctcagaattcaattcttcccagaaaccatcccgcacagtcatctcggcgttgcccagacgggaacggaacagatcggttatttcatcattttctctcttcatgatttctatattctttaatcctttttgccaataaaaactttgcacggtgcaactgcgaagtggatgaatgctccttgatacccaacatttcggctatctctttgtgagacttttcctcaaacacgtaaaggttaaaaaccgtccggcagccatcgggcaagtctgcgacaaacttcatcaactgttcttcggatatcggtcctgcctcccctccttccggaagatcgggaatatcaggaagctgatcctcgtgtatcaccaactgactgatccgtttttgccttcgcaggtaatccagtgcctgagtcaccatcacccgggtcacccacgttccgagcgaagactcaccacgaaacgagaagttggtgaatattttgatgaaaccgtcatgcagtacatcgtgcgccgcttccatatcgcccgtatagcggaaacataccgccaacaattgcctcgagtatagggtataaagttccttacgggccgaatcctttcctgcccgacagccctttatcagttctatctcgttttccaatgtcaattgtctttttaaaatcgaacgtatgtctgcgtcgtttgtctattagacgcaaggatgcaacgaatgctgcaaacaatagtgcaaaaagaagttaaagaaacaataaacgatgaataggcctttgcatcaatgcgtagcctgttcatcgtttatcgcttaagaacgtttatcgccgaccgttcaaaatgtcagcatgccttgaaactcatatcgagtccctttaccgaatgggtaagggcacctaccgaaataaagtctacaccacactcggcatagtcatggagtgtatcgaacgtgataccaccggacgactcggtctcatattttccgccgatcatctcgacagctatctttgtattttcgggagtgaagttatcgaacatgatgcggtctaccccaccgatattcaacacctgctgaagttcgtcaaaattgcgcacttcgatttcaatcttgaggtcttttcctttttccttgcaatattctttagcgcggttgatggccttatcaatgccaccggcaaagtccacgtgattatctttcagaagaatcatatcgaaaagtccgatacggtggttgacacccccgccaatctttaccgccgctttctcaagcatacggagtcccggagtagtcttacgggtatccaacacacgtgttttggtgccttccagctgcttcacgtatttgcgtgtcatagtggcaatgccgctcatacgctgcatcacgttcagcatcagacgttctgtctgaagcagagactgaattttaccttccacaaccattgccacatcacccggcttcacttcggcaccgtcgttgataaacacctcaaccttcatagtcggatcgaaacggtgaaatatttctttggcaatttcgataccggccaatacaccggcttctttaatcaaaagtttcgattttcccattgcagtggcgggaatacaggaaagtgttgtgtggtcgccatcacctatgtcttcggcaaaggccagatcaatcagtctgtctattaactcattcattggttttatctattcttatttgatttataaaatatttgttctgtaccctgcggaaaaaacagttcacccggaaattgccgttagcagtggtcagggtaccgataataaaactcgactcctctcgcttaccttcgtgatttacattaaaaccactcaccttgttgctattaaagaaagaagcaagtgtcccttcagcagtctgtttgtcgacgcttgtcgagcgattctgaatcaccagatccaccttctctcccaaatacttgttcagttcttgggagtttcctttcttaaacgccacgaccacgcccaccggtatgtcctgtgcgaagagcgaagttacagcgaatacgagtccggccatccataaaagtacccgttttttcataatcacaagtattatcgatacgcaaaggtaagtatttaatgctaaaaacaacatttttttcttatttttgtgcaataaacaagagtttgcacttgaatgaaaacaacccttatcgtcgtaggacggactgtagagcagcattatatcactgcaattaacgattacatagagcgtactaaacacttcatttctttcgatatggaggtgattcccgaattgaaaaacacgaaaagcctcaccccggaacaacaaaaggagaaggaaggcgaactgataggcaaagccctccaaccgggagacgtggtagtgttgctggacgagcacggaaaagagatgcgttcggtggaatttgcacgctggatggagaagaagctggtaaacgtcaacaaacgcctggtattcatcataggaggaccttacggattttcacaaaaggtatatgatgcggcacacgaaaagatatccatgtcgaaaatgactttttcgcaccagatgatccgcctgatctttgtagaacagatgtatagggccatgaccatactgaacggcgggccctatcaccatgaatagggttatcccctattcatgattcatcaaccgccgggcagccatctcttcatatttcgttccagggcgaccatagttggcatacggataaatcgaaataccgccgcggggtgtaaagataccggtcacttcaatgtatttgggatccatcagacggatcaggtctttcattatgatattcacgcaatcttcatgaaaagcgccgtgattccggaagctgaacagatatagcttaaggctcttgctctccaccatcttcacatcgggcaggtaactgatacgtatttcggcaaaatccggttgtcccgttatggggcacaagctggtaaactccggacaattgaaacgtacccaataatcgttctcaggatgcttgttatcgaaggattccaatacttcgggagcataatcctgcttatattcggtctttcttcccagtaaagaaagctggtctttcagttcagtcataatctattaatcatttaacggtttcttttacttaaatactcttccagcccctgtttccgcaatttgcatgccgggcagtgtccgcacccgtcggcaggaatcccgttgtaacaggtcagcgtctcgttccgtacaagatcgaatacgccgagttcgtccgccaatgcccaggtttcggctttatcgatccacatcaacggtgtatggataacaaactgttcgtccatcgccagattcagagtgacattcaacgacttgataaacgagtcgcggcaatcgggataaccactataatcggtctgcgaaactccggtaaccaagtggaaagctccctgttcacgggcaaagacagcggcaatactcagaaagaacaggttgcgtcccggaacaaaagtgttcgggaacgaatcttccggcttatcttcgtccatcgagatgctggtatccgtcaacgaattgcttccaaggctcccgataaaagaggtgtccatcacatgaaactccactcctgccctttcggctattccccgggccagttctacctcgtgtgcatgtttctgtccgtacaggaaactaagcgcatatactttgctgaaatgcttcttcgcccagaagagacacgttgtagagtcctgtccgccactgaacagaactactgctgaatcatttttcatcatttattttcttgaaaaaagtgtttttaagttctccttattatatatcctttaccttaagtacattataggagatgtcggtatcataaacatcgctcccgtcaattctcttaacggctttcacgacacggatggtgatcggaaggataatcacttcgtaaagggacttcagcacaatctgagtgcccatcattaccaacagctcgggccaggcaatcagtccgccgaatgcgatgggaaagaagatcagtgaatcggccgtttctcccactaccgtagaccagatggcacgggcagaaaaattacgtccgccactggccactttcattttactcatgacataggcattgagaaacgaaccgaccagaaaggccaacagactggctacaacaatgcggggagccatgccgaacacaaaatcaaaatgctgttcgccttcccagaaaggtgctgcgggcaaggccacggcaatcagcccgaggcctaccacaaagaagttcatggcaaatccgctccaaataatcagacgggcctttttaaatccccatacttcggctatacagtcattgataatataggatatgggaaacaccagcaatccggcagtaacagtgatactgccaacctgaatcactttggtttcgagaaggtttgctgcaatcaggcagacgttgaacagaatgccgagtaacatgaagggtatagatactttttctttcataattcctgttttttacgtggtgttctagaatacacgaccgctattcacggcatcatacgtttacgggcagcaaaggtagcaattcttttttaatcgacaaaataacaatatatgtaacggggcattacatatattgttatcgcgataacatataatgtaatgccccgtccgggtacaacataacaaacacttaacacactattctttttactcttgtcacagagttgcaaaagcccattcatacttccggaaaatccggcatcgatcttaataagcgctcttacgagaagtctttcaaatcctgctgtaatcttttgcggatcaggaacagacggctcttgatagtccctaccggcaaatccatcttctcagctatctcacgatacttgaatccggcaacaaacatcaggaaaggcttcttcaactcttcgggaacggcattaatcaccttatagagttccttcagatcgtaaattgtttcaaagcggttgccgtcctcaccttccgtcatggtttgcgcatagagattataggtggaatcggtcatatccacttcacgtaacgacttacggtaattattgataaagatattgcgcatgatggtatacatccatcccttgaaattctgggtatgcacaaatttctctttgttgtccaatgccttcaacagacaatcctgtaccagatcattggctgactcccggtcagcagtcagtttataggcaaaatgttccaattcgggctgcatagccactatcttatgggtaatattcatcttttccattgctcttctttctttctgattatcgaatatgcaaagattcgcattttaaacggtctgtcctatagcaattcttccgcataatttggcgatttttccctcggcccttcaaccatttcccatttaagttgttcaatagggcaattcacctaaaacttaacttataatgaaaacattttttagatctgtagctatgctactcggattgggactcttgcctgtagcggcacatgcccagaaaaaagtaattatcgaagatgaagaaccgaactccgtgatgtttgtatcgaccgacaaagccggagacgagattatccggatcatgaacgagacgcgtcttccacgtttccaggaaccgaaggctccgcgcttcgtactgaccgaccggcaaggaaagttcgcactgggtatcggcggatatgtacgggcaaccgccgaatatgacttcgggggaattgtgaaagatgtagacttctatccggcgctgattcctaataaaggctctgccgaccgtgcacgcaatcagttccagatggatatcagcacttcgactcttttcctgaaactggtgggacataccaaacgtctgggtgacttcgtggtttatactgctgcaaacttccgtggagacggaaagactttcgagttgcagaatgcttatgctaccttcctcggctttactctgggatacagctatggtaactttatggaccttgccgccctgcctcctaccatcgactttgcaggccctaacggctcggctttctatcgaaccactcaattgagctatatgtgtgacaagctgaagaactggaaattcggcgtcggtgtcgaaatgccatcggtagacggtaccacgaatcagtatctcaccatcaacacccagcgtatgcccgacttcactgcctcagcacagtataactggaatgccaacagccacctgaagttagctgccatcgttcgcagcatgacttattcaagttccgtagacaataaggcgcactcaaaagccggatacggacttcaagcttcaacttccttcaacgtgactccgaaatggcaagtatacggacaggtgaattacggaaggggtatcggacaatatctgaacgacttgagcaacctgaatgtggatattgttcctaacccggaaaaagaagggcgcatgcagacgctccccatgttgggatggttcgccggattgcaatacaacatcagcaaagatgtatttgtatcgggcacttacagtttgtcacgcctctactcggaacacacgtatccaagcgatgtacccgatatgtaccggaagggccaatatctggtggctaacctgttctggaacgtaaccagcaacttacaggtaggcgccgaatatctgagaggatggcgtacggacttcagtagcaatacccgtcatgccaaccgcatgaacgcattggtacaatattcgttctaactttttataaatctctctgaactctaacgtaaaaaagtccaaggacgaacccagccccgtctctgttattaccctacggagatggggctaataataaaatttcaccacacagggattatcatcttccactcttttacttaatgcccggctgcaagaaacgcatgcaaagctcaatgcagcaaagaaaagaaaaaatgtgtctctcatatctttcgggattagaacacaaagataatcttaatataggaggttaaatgaaaaaggaccggattatttgagtaatccgatccttcttgagagttatattaataaagattagtagaagccttgtatcagaacttatagtcgagaccgataccgaatactttattggtacgagtaaagacatcctttccgggcattcctgtaccattatagctactcatatctttagtatatttgtcataatcagtccagaaataagcaacgttcagtttcaagttcttagctacattgaaacctgccccaaaaccatacgagtaagaacctaccgcaaagctcatatcactctgataattgtctttcaccccatatttagtacgttgcataccggcacttatctgtgcccacttgcaaatatcccattccataccggcaagatattcattcgttccgttgccaatataattatgtttatcgaccaatgcaccggtagcaggatcttgtacagtagccatctttgcatgtgtatcaaagaaatggtgataacctaccgaagcacgtaataccggcaagatttcataagacacaccgacagtcagcaaactaggaatatcatgtggagtattaacgccatcccgatagtttgcgaatttatcttttgtcggatcggcaggagcggcaggcaatgtacccttcgttttattttcaacgtttaattttgtattgaattcatatttcacgcctacattccatttgcccattttaaaatcagcaccaataataggagtaattccccatcctgactgtttacagtcaagttccatatcggcagtctcacctgctacagccgaagctcttgcagcatcagtcatatatttgatatattcaggagaacccggctcaaacttttcagcagcagccattgcaccggcagctaaagtagtaaaatagttattcagatttaccagtttatcacctcccccgatatttgcctgaatatctttcaaatatcccgaatatgcattacttacataattaatacgtgcgccaccaaaaacagacagataatccgtaatcttataggtagctcccaactgcaaaccgaagatgtactgtttaccttccataaagctattaacagaatatttatctgctacaaaaccttgtcctttcaacaaattcggaatcacggctacctgtgattcaaacgaacccaatccttcattaaaagtagctttaccgccaccgccggtaatggcaaagttagccgagaatgcccacttatccttcttatatactgcaaatacactgggaacaaacggagccgaagcttcacctttatatacttttgtagcgtttccgccaaagcctacaaacggagcgaaagtagaagtgatggttcttgtctggaaagcactctgtccgttgagagacagatgaaaaccatcttccatgaaagcgacacctgccggattggaatatactgcgtcaatttgtgtagaagcatcacgagccaacattctcaaaaacaatacgtgctgattggtatttgtcaggagacctcccgcaaaagttgaagttgaaacgattagcaacccgatgctaatcaagaataattttctcatctaaatcttttttaagttatttcgggcgcaaaggtacaataatattgcacatgacgaatatttctgtgcatctaattacgttttcaccaacaaattaattgaaaacacaaactgtttcgattgaaacgaacaagaaaacatcataagaaaagacactcggaaagccaaacattactccattactaaacgtttttatatcatatagaatataaataagaaaactatggcatatacaatcgcattttttggtaccaaaccctacgatgaagcttctttcaacgaaaaaaacaaagaattcggattcgaactccgatttttcaaaggtcacttgaaccggcacaacgtgctgctgacccagggagtggatgctgtctgcattttcgtgaacgacacagctgatgctgaagtaataaaaacaatggccgccaacggggtgaaattactcgctcttcgctgtgccggatataataatgtagacttaaaagccgctgccgaaaacggagtaaccgttgtccgcgtcccggcctattcaccgtatgccgtagccgaatatacggttgccctgatgctttcactcaaccggaagattccgagagcttcgtggcgtacacgggatgggaacttctctctgcatggactgttaggtttcgatatgcacggaaaaacagcaggcatcatcggtacgggaaagattgcaaagatactgatacacatcctcaaaggattcggcatgaacatattggcctatgacctatacccggattataactttgcacgggagaaccagatagtatatacgacgctcgatgagttataccacagctcggatatcatatcattacactgcccgctcactgaacagacaaagtatctgatcaatgactactcaatcagcaaaatgaaagacggagtaatgatcatcaataccggacggggacaattgatccacaccaatgcgctgatagagggattgaaaaataaaaaaattggttctgcaggactagatgtatacgaggaggagagtgaatacttctacgaagataaatcggaccgtatcatcgacgatgatgtattggcacgcttgctgtcattcaacaatgtgattgtaacttcacaccaagctttcttcacgcgcgaagcattggcaaatatagcagcaacgactctggagaatatacgggatttcaagaatctcaaacctttagtaaatgaagtaaaattggggaatacttaaaatcctcaacagcaatagtgccaccgcttcctgcgaaagaagcggcagaccttatcaggtttgcccggacggtaacgcaaagtgtccggagtggctattcattaatcaagcactaaaacagtcagtactgtttccgagtattcaccgatatgacagcctcggtcttgagttccattctcgttacaccacattcctttaataacaaatctctgattgtcgtctacatcaacaacagtttgcagtgtgataggaacgcgttgtccatccattccactataatatacacctctggttttgatttcatcgtttacagatatagcaaaccatcctccatcaccagctttgtcacaccacgtatccggaacattcaatgttattaatagttgatttcctcttacggcatctaacgaaatcggactaagttgttcgatgggctgaaaacaagaattcttgtcattcgcataataatggcctctcgttgtaagaatagaaccattatttcttctcttggatgaaaaatacaactgactcataactatttcttttaattaatttcctactctattctggattttcggttcttccgttctatgtcaatactctataatgctctctaacaaaggttcccccttcagcggagcataaatagttactttagcaaaaccatacttgggctcgcgggttactgttttagtcatacagatgaagcggtagttatagccgcttaccagttgtttggcaaccagaagtggagtgtaatccacccctttcaaagtcatgcaggtctggaacaattctttgtcctgatccgtcaacggttcaaattctccccagcctcctattattatattcgctttctcggaagtaaccaccgtataagggaatacgtcttcgtaaaggactcccgtgacatcacgataataggcaaactgaatctctacctgtcccggctgcaaaaactggaaggtaaaagactgtacagacattccacccaaggtatcggcatcttctgacaattcctccacaagggcaactccaccagtcaggcgtactaaagcgtaacgataaccagtacctgcatgtgaggtacgtttgatggtgattgtatcacctactttgaatgctttcctaatcataacaatacgtgttttttaaaagattaactctgtgaaattttctaatagcctgatgcagtgaccggccttgctgagaataatctgccgggagaaaactcccagcagattttgggtacagtacatcacctaaaccagattcgttgatgtggttcaaaggtaaagggaaagatttacagatcaaaatacttgaagtgggttattctctcattttttcactcttagtctctcattttttcactttcactcagtaatttccttattactaacacgttgtactcctacctgaaaatcggtaggagtcaccccaaatttaccggaaaagagacgataaaaagattgggtagacattccacactcctgggctatcgtgtctactgtataatcggggtaatctttcagcatcttggcagcatactccaaacgaagattattaatgtattttgaaaaactcattccggcatattgcttaaaaagcggcgcaaacttattcttgggaatgtagattgtcttgattaactcctctctcgaaaagtccggctgaagatataactgccggttaatgatttcacgctccagtttgtcgaacagcattttatcgtgtaccgcattgttatcttccgtctcgggctccggatcgacaggaacatccaactttccgggctcttctgcctgcaatgcatttccatctatatacgtccgtacttcccgctctttctgtaactgttctttcaatagatggttctcctcttttttccggtagagttcttctttgtatatcagcaaatcctcaatggttcctaccatcgccttattcttacagcgtatggtacggttgtgccggaaagttctccataaaagtatccctaacagaaaaacaatacagaccacaaatatcagtagggcatttcgcatccgcatatcagcggcttgctgctgaatgaacatatccttttcattcgtttcataaaccgctgccagttccaatgcagcacttttctgctctctggccttaatgctatcacgcaacacagccagctgctcaaaatatcttgcagcagtccggtaatcacctttatcttgataggcacgtccgagggacttcttaatggtgaccatgtaataatttaccgtatctttccgcgtgacatataccttttcacgggcggagttcatgaggatcacctgatcatacatcttccgatcgaacagataaggcataatcaggtagtcatcgcgatcgtattccttacttactgacaaaaatagtcggtaatagcggtcagcctcttccgaccgccccaaccggaaaagaaccacagcataatgggcatacatcgcctttttctcctttccgctcaatccctccatcggtatctcactgccggtctcttccgtcacgatcctttctaatgcagccagtgttttcagggcctcttcactacgcctgtccgactcctgaaatatcagcaaagtattgtaattatagcgcaggttatcgtacttatatgggtagtctgttttttccatcatcgctaccgcctgctccatgaattcatatcccttatccttattaccctgataatagagcatcttccccatattaaacagagcaacggactgcatcgctttatcatcacacagttcagccctcttcaaaagcaaatccacatactgtgcctttttattctcattgtgcaaacagtcataacacgaaatcatacggtgcacctgttccatatagtttttatcactattgagcaccgagtcactttccaaagcacgcttatagaatttcaacgcccagtagtattgccctacattgaaatacaaatcgccttccaccacatccaagcggaacggaggaagcgacttctgtttcctcaactgctccatgatctgctgcgctttttcaaagtcggagaatgtatacttatatacgttgtcatctgtaatcaaactgtctggtaaagaaaacgttccggcgcaaacagacaccggagatataaaacaatgaagcagtactaacagaataacacacaataactttctcatatcttcttactattggcggattttggaagcacaaaaataagataataatattttcaacaaaattttctccggctcatatttaccgaacgcattcaaatctcttctgtttaccggatttcaagagcctgattgtttctcttctggaaccgcctccttccccttgttcctaataaaaaagtgaacgcttcaaaccatttatacttcccaattgtttggcttatagaatacattttaaaagaaaggatacattatgaaaaaggtagttcaccgctcggatacccgcggacgatctttatatgactggcttgacagccaccacagtttcagctttgatgaatattataatcccgaacgcatccacttcggcgctttacgggtgctgaatgacgatcgtgtcgcaccgggagaaggttttcagacccacccacataagaacatggaaatcgtctccatccccctgaagggatttctggcacacggagacagtaagaagaacagccgtaccatcactgttggcgatattcaggtgatgagtgccggaacaggcatctatcatagtgaaatgaacggcagcaagtcggaacctgtggagtttctacaaatatggatcatgcccaaagagcgaaacacccacccactctatcaggactacgacatccgggggttgctgaagaaaaacgaactggccctgattctgtcaccggatggcagtacaccagccaaactgctacaggacacctggttctcgatgggtgaagcagaagccggaaaaacgcttgaatacaagatacatggaacggatacgggagtctacgttttcctcatcgaaggagaaataaaaatagacgatatcatcctgacccaccgcgacggattgggaatctctgaaaccaaaagctttgagatagaaaccctgaaagactccaagatattactgatagaagtaccgatgtaaatttaaagtaattgcttatgtcaaccgatcatacgtccacacatcctgattcccctcttcacggaagaggggccgggagtgagactatcaacctcgctgccatccggcaggagtacaccaaaggcgggctgaaggaaggagatcttcccgacaacccgctttctcttttcaaccgatggctgcacgaagctatcgatgcacaagtagaagaacctacagccatgctggtaggtaccgtatcccccgaagggcgaccatcgacccgtaccgtattgctgaaagatttgcatgacggaaaatttatcttttataccaattatgaaagccgtaaaggcagtcatctggcaaagaatccgtatatttccctctctttcgtctggcacgcgctggaaagacaggtacacattgaaggtatttcctcaaaagtccctgccggtgaatccgatgcctacttccaccaacgcccctacaaaagtcgcatcggagcacgcatctctcctcaaagccgtccgttgaagagccggatgcaattgattcgcagtttcgttgcagaagctgcccgatgggtaggcagagaagtggaacgtccggtacactggggaggctatgccgtcacccctgaacgaatcgagttctggcagggtagagccaaccgactgcacgaccgctttctctacaccctccaagcggacggaagctggcagaaagagaggcttgccccttgatatttccggttattgtgcttgcgcaaccaacaaataatacgtaatattgcattcataaaatacatccgcttatgattctggattatatataccacagcgggttcgccatcgaagcagaaggtgtaacccttatcattgattattacaaggactcttcggaaacggaacgaaataaaggtatcgtacacgaccgtctgctccaacgacccggcaagctgtatgtacttgcctcacattttcatcccgaccattttaaccgggaaatactgacctggaaagagcaacgtccagacatcatctatatcttctcaaaagatatcctgaagcatcatcgggcacaaaatgaagatgcgatctatattaataaaggtgaggagtacgaagatgatacactgcgcattcaggctttcggttctacggacgtaggcatctccttcctgattcatctgcaagggaaaagcatcttccatgccggtgacctcaacaattggcattggagcgaagagtctaccgaacaagagatacgcaaagccgaaggagactttctggcagaagtgaaatttctccgggaatctgctccggccgtcgatctggtaatgttccccgtcgaccgccgaatgggaaaagattatatgaaaggcgcccaacaattcatcgaacgaataaaaactactatatttgtacccatgcacttcagcgaagactacgagggaggtaatgctttccggtctatagccgaagccggtggatgccgtttcatcaccatcactcaccggggcgaaagctttgagatataactaaataaaacatacgattatgaacaaactgacacaattttttctcgtgttatttatgatttgcctgcctgcaaccctttgggcagacaatgacaaagatgatgatgacagcagataccttgcgggcgccgtgcccgaagttgacggacgggtagttttcagccgcgaattcagcattcccggcatgtcacaagacgaaatctatgaacggatgctcaagtggcttgacggacgcatggcccagaacaaaaacaatagccgcgtggtatataaagaccaaggtgtcattgccgcaaccggcgaagaatggctggtattcagctctaccgctctttctttggaccgtacttggctgacctatcaaatcaccgtcaactgccagccgcagaagtgcacaatggaaatagaaaaaatccgctacacttatcgtgaaaaagaaaaatatacagccgaagaatggatcaccgataaatttgctctgaataaaaccaaaaccaaactggtacgtggtcttgccaaatggcgcaggaagacggtagactttgccgataacctttttgaagaggcagcaaaagcactgagccaaaaacctcaggaagccgcagcagcagaagccgctccgaaaaagccggcagtagtgaccgctccgaaagttgtggtaatcggtggtgaaaaagaaactgaaaaggtagaaaaagcagctacggttacccccgcaatccctgttacccctccaagcacaatgccgggctataaagaggtagctcccgatcaagttcctgccaacgccatccagatgggtgcaggccgactggtgatcgctatcggctccgatcctttcaacatgaccatgatgacagctaacgccggaggatccataggaaaaatttccggaagccctgttgtattcagtatcctctcgcccgaccagccttacgagcaattggagaaagcagagacatatagcatacgtttctatcctacaggacaaagcgagccgtctgtcatactggaatgtcagaagctgcctgccccgacaccaatggaaggacagcccagaacttatgcaggtaaaataacaaaagcatttatgaaataaatcagccaccacagattacacggataaacacagattgaattttaattagattattaatataaacaatctgctctaatcagtataatctgtggtgcaactttataagttctattttaacctaaaacaaaataaacttagcaacaatggaaataaaaagtagatttgaccactttaacatcaatgtgactgatctggaacgcagcattgctttctacgaaaaagcactgggactgaaagaacaccaccggaaagaagccgccgacggctcctttatcctggtatatctcacagatagcaccaccggattcttattggaactcacttggctgagagaccataccgaagcatatgaattgggagagaacgaaagccatctctgcttccgtgtaacgggagattatgatgccatacgccaatatcacaaagaaatgaactgcgtatgctttgagaatactgccatgggactgtattttatcaacgatccggatgattactggatcgaaatattgccggagcggttctaaaacgataaacgacgcatgtttctaaacaatgaacgataaacaggctgcacattaatattgcaaacagtttatcgttcatcgttatttaccgtttatgtctattcgcccgctttctccggatttcagctttcatcttggctgctccggaaccatgggttccctttatataagttgttttcttcgcttttgttttcactttattttcatcttttttcgggccttctttctttcctttaaagacaatcccacccataattgcatcttctaaactcataatctttcctttcttattctatattttccgtggacaaagatactctttttctgtgaattccctatctttgcccgctgtaacaactaaaaaacaatcaatggatacattcctgctcccggcagaaaaagacccgatgggtgccgccatagccgattattatcacaatcacaaggcagacagactgcgtgtattttcttctcagttcgatgaagacgaaatacccgtcaaacaacttttccgcgaagccggacagatgcccctgctcgaacgcacagctcttcagatggctaccggaagagtactcgacgtaggtgccggaagtggctgccacgcccttgctcttcagaaagccggcaaagacgtttctgccatcgacatatctcctctggccgtcgaagtaatgaaacaacggggagtaaaagatgcccgccagattaatctgttcgacgaacactttgccgatactttcgataccatactaatgttgatgaacggttccggtatcatcggacgcttggagaatatgcctgtcttcttccgtaagatgaaacaaatactccgcccgaatggttgcatcctgatggattcaagtgacctccgctatctgttcgaagatgaagacggaagtttcctgatcgacctggccggagattattatggagaaatcgacttccgcatgcagtacaaagacattcaaggtgattctttcgactggctgtatatcgacttccagaccctcagtgcctatgctgccgacaatggcttcaaggccgaaatgataaaagagggcaaacattatgactacctggccaaactgactgttgtcccgtgaccgggcaggcatgaaaactcccgataaccggtcctcctaaaagactaaaacggaaacaataacggcaacacgaacaccattaccacgcccataatgatctgcaacggaagaccaacttttacataatccataaatgtatagcgtcctgccggcatcaccagtgcattaggcggcgtggagaaaggtgaggcaaaacacatactcgccgccaccgtcacggcaaacagaaacggatagggactcagtcccaactgtacggcagagtgaagcgcaataggagcaagcagcaccgcagtagccgtattgctgataaacatcgtcatcagcgaagtagtgaaatagatgcctgccaacaaagcaaaaggcccgtaagtacccagaccgttcaccaatgattgcgacaccacttccgaagccccggttttctccaatgccaatgacatgggcaacattcccgctatcaatacaatactctcccagttgattgttttataagcttcttccacattgcggaaacatccggtcagcaccatcagcagagctgcgacaattactgccgtcacaggggccaccggaataaagtcgaacatcatggttataatcatccccaacatgatcagtgccgctaccggtgctttatggttcaaggtcactttagctgcttcagccaatggttgccccagaacgacccattgcgactggtcttcaccaagcctggcaatgtttgcccaacttccctgtaccagcaagacatctcccgaatgcattttttcatccttcaggtttttcaacaagtagtcacgcttgcgctgaattcccaatatattaatgctgtaattctccctgaatccggaagcttttaccggtttgtttatcaaattggcagtaggcagcaacaagatttcggcaatgcctatctcctgaaaatcgaaaccttcatccgtattatgcaaattaccttccgtcttatgtgtatccaataaagccagacgattctcaccgacaaaacgtttcacgttctcaaactcccctaatacattaaagaatatcttctgcttcaatcagggttcccgcttctgccatctcctgcttttttgtcttaaaaaagtgtcgggatgaaaccgatcggcgacgcacttccagaattgtcacatgatacctctgcggaatccctaactcctgtattgttttaccgacaattcctgaagattcttcgacctccaccctatacaggttctgcgataactgatattcccccgccaattcctgaagcgacttattcttatgctttccccgcgtttctttatctgttttcttcgtcaggaatatcttgctcagcgggatcagcacaatcagaccgacagtaacacataccagtcccacgggagtgaaggtaaagaaagagagccgttcatatccggcttgaatcaaggcattctgtatcacaaggttaggcggagtaccaatcaacgtcatcataccacccatactgctggcaaaagcaagaggcatcagcagacggcttacattgatattggcactcatggccatgctgaccacaataggcagcatcaacgccaccgttcccgtattgctgacaaaagcgccgatagccgctgtcaccaatatgatcagtacaaagagtttcaactcgcttgttcccgcaaacttcaggatacggctactgatcatctttgccagccccgtttggaaaatagctccgcccaccacaaacagaccgatcatcataataacaacagaattggaaaagcccgaaagcgcttcctccggagtaaggatattgaaaagtattaataataccagcgcacacaatgccactaagtcagaccgtacctttccactcatgaaaaaggcagccgacagtacgagaataataatcgttatagccataaaataaaaagatggggtgattccatgctaaaaacaaaaaatcacccctgcttgttcaacttatttcttcagcatttcatcaatttgatttaccagtgaagtaaattcctcttcgttatacaaacgagtcagcttcacaatcttaccttcccggtctatcagtacattgcgggtgatacccgattcacgcaatgcatattttgcaaatatatccgctcccggatccaatcccaacggataagtcacccctaccgacttaccaaatgcaatcactttgtcaagaggttcgtcacgatcaataccgatcaaggcaaactccggattgctttgatgtttcagccagatatctttctctataaaaggcatctctttacgacatactccgcaccaactggccgtgaattgcaacatcaccactttgccacgaagtgcagaaagctctatctgctttccgtctgtcagagtaatagtaaaatcgggggccatctctcctactctcacaatatatcctgtgctgtctgccgcaacactatccgttttcaccactacactatccgcaacaacggttgctttatccgcttttccctgtccggaacatgctgccataccccaaagaagcaatgacagaccacatacataaaaaaagttcttcttcatacttttctataattaattgatttgcaaaagtaaacaaagaatccgatttatcaaacactatttttatgaagcattttttgccaaagtatttgcaagtttaaaagtttttcctacctttgcacccgcaaaacagaaatgacgcctctttagctcagttggccagagcacgtgatttgtaatctcggggtcgttggttcgaatccgacaagaggctcaataaaagagaaaggatcagcaattgctgatcctttctcttttattgaattaatttctttccggaacttactcccgagctactcctccttcttctttctcacgtaataaggtacaaaaacaaaaagaaggattttccccactttctttaaaaacgtatctaacgaatgatgctccaaaatgtcagaaatataatttttaaatattccttcaccgaacgattacatatatatttcatattataccgtattttatcgggcataatctgttctatatatgccttgtcgggatccgaagcctttccaagaatcgtattttcatccacatattcaatagaagcataatccgtaattccgggacgtacgctcaatacctttttctggtcatcagtatacaaatccacatacttacgaacctcaggccgtggtcccaccagactcatatcacctttcagtacattgaacaactggggtaattcatctaatttatacttccggataaaatacccggtacgggttattctgggatctctcccccccaccgttatcagtcccttcttatcagcccccacacgcattgaacggaatttatagacataaaaatcccgcccgtattgtcccacacgaagttgtttatagaaaccgcctcctttactttcaaggcagatggctatataaagaaagagaaaaatgggagaaagcagaagaattcccaaaagggaaaaaacaatatcaaaaaaacgaatcaagaagcttatctgtttagtgtttgtaaatatactatctgttttctgcgattacagtcgtataggccgcctttacagtatcaataatgaaattcaatttttcactatccagttgaggatatatcggcaatgatatctcacccttaaaattctgataagcctgtggataatcattcatatcatatcccatcgatttgaagaacgacaacatcggcatcggtataaaatgtacattcacagccacttcacgtttagcgatctcgtcaatcatccggtcacgttgctcttctgtaaagtctttcacacgcaaagcataaatatgataagagctttccttttctccatctacagaaggcggaacgatggcccagtcacaagtcgaaaaagcatcattgtaagtattgaacaccctcttccgctccttcagtaactccggatattcccgtatttgcgccagtccgatggcagcattcacatcggccatattgattttcattccgaaaccgacaatatcataacgccatcctccggctttagatttcgaaaaagcatccttagtctggcagttcaggctcatcatccggagttctttatacagctctgcattatcgaacggcttgggcaagttcaaacaaatggctccaccttcggcagtagtcacgttcttcacggcatggagtgaaaagatagccacatcagtttcgcaaccggtacgctgccggttactgtaacgtgcccccaaagaatgggcagcatcattcatcaccaagatacgccctaatttttcttgcacgggagattccgcacggaacaattttatcatttcagattcctgtaccagtgccatgatcttttcataatcgcaaggaaaaccggcaatgtctaccgggataattgcctttgttttagcagtaatagctttacgaacagcctctaccgagatattaaaatccattccggaatccaccatcaccggtttagccccggcatgaagcacggccaatgccgttgcgctataagtataagcaggaacaattacttcatctccctccttcactcccagccaacgcaacatcataatagctcctgatgtccaggaattgacacaaagtacttcctttgctcccgagaaagattttatttcttcctccaaagccttcactttcggaccggatgtgatccaaccggaacgtaacgaatcaacgacttcgttgatgaccgcctcgtcaatataaggtggtgaaaatggtattttcatgagttatatattttataagaaaagtaaaattaacgaactgttttgtagattatatcaagaactgatttaggcattaatttagccatagcatacagcaaagcataacagtcttctttccatccaaaccccaacattctattgacgcgacgacgtaaggtataaatagatttggcatgtttccacccccgccttctttcgaaaaagtttaaatctaatctaaatttgaataagtattcgggtacattggcaaatttacatccacttttaaaacccttagcccacatcatagtatcttctccaaagtaagtgtcttccggatataaaccagctttctcaaaatatgaacgccgaaacatcacagtaggatgaatcatacaatcccgctttttaaatagttccaaacattcctcatgggttgtcggcattttttttcggaagtattcttttccctcattatcaatttctattgcccaagtaccaagacaatcaacatctggatgtgagtccataaatgcgatctgctttgcaaaacgttccggcatggaaatatcatcagcatccatacgagcaatataggtacaatcctcctttttcaagataacatctaacaactcatttaatgaataagccaaccccagattcttttctctcgtatttatacagatttgttctgttaacaaattagttacataggaagctacaccattttctataggaccatcacaaataatatataaataaaaagaagtatatgtctgattaagcaaactttctatcgcttcttgaactttcaataaagtgtctttcgcatacaaagacatgataacatataacatgaatataattatataatatcttttttaaatctgttaaacttaagatcataaattgaatacactacaatcataaaagatggaatgataccaacgatacaagacaatatagcattaagtatatccctcttcctaaaggaagtctttgaaatattcttttgagcaaaagcgatagctgtactatattttttctcttttaaataattatatataatttctttccattgtgcctgataaatatcagcctgctcttgagtccccaatatttcgatatcagtggcaaacgtttgtaacaacttcctcttcacctccaacaaaacatcagtacgaggtgtatttcttattccatcagcacaaattactacatctacataaggaagaatttctatttgatagaatctaaatagacgaatcaaaaactcccaatcctgatgccgcttaaaagaaatatcaaacaatcccaccttatttaatacctcccttttaattattaaagtagaaccagcagcataatcaatttgtgctgacaacaactcataacatgaattaaagcagcccacgtttcgacttactttatatatcttatttttatatttctttacgtaattacaacaagtaccaccacaatccgcacttgaattttgtagaaaatgtatggcttcctttattcgatcttttaagaaataatcatcatcatcaagaaaagcaatatactctcctacagagttttgaataccagtattacgagcggcagagccattctgatttgttttatgttttatatatttaactctataatcgttagcatacctttccatatattggattgtttccaatcgatatttatcaccatcagaattgtcatctacaaccaccacctctatattagtatagctttgaccgagtacactgtctatagctcgtcccaacatattgggacgtttataagttggaataatgacactaactaatccagaaatcatattaatcttacagccgtccatcaacaattgctctgtctaagaagcatttgacatcaaaaacaacagaaatatcattgccaagtgcttttatatcaattgttttaaactcattatgtccaaccgccaatattatagcatcgtattttttttcattaacattatcaatcatacgaataccatactcttcatacactttttctgcatttgcccaaggatcataaacggaaatattcttagtatactctaacaaagttgaatatatatcaacaacttttgtgttgcgtatatcagggcaattctctttgaaagtaataccaagtagtaatatattagaatctttcaccaatactccctttttattcatcaacttgattacttgattagcaacataatcgcccataccatcatttaatcgccgggctgaagacattattcttggtaaaaccccatacacttgcgctttttgtatcaaataatatggatcaacgctaatacaatgtccaccaactaatcctggtctcaattttataaaattccattttgacgaagcagcctcaatcacatcattggtatcaatatccattgcattaaatattttcgctaattcattcataaatgcaatattaacatcacgttgagagttctctatgattttagatgcttcagcaactctgatagaaggagctttgtgtgttccatttatcaaaacagaattatatactttatctactatgtcagcaatttctggagtagatccggatgtcaccttctttattttttcaacagtatgttctttgtcacctggatttattctttctggtgaatagccagcaaaaaaatcgagattaaattttaatccagatacacgttctacaacaggtaaacattcttcttcagtaacccccggatacacagtcgattcataaacaactatgtcgccctttgaaattacttttcccacagtttcactagctgatatcaacggtgttaaatcagggcgattatttctatcgaccggtgttggtacagctattacataaaaattacaatcacgtatatcttccaagttagaagtgcatttaaaaccactatctaaagctgattgtaacaaaacatcagcaacttctaaagtagtatcatgcccccccattaaagattctactcgtttctgattcatatcaaaacctattgtttgatattttgttgaaaataagcgagccaaaggcagacctacatatccaaggccaataacagcaatcttcataatatgatatttatttaaataagttgaaattcatagaataaggaaccaaatcatacaaatgtccattaaaacaaatggtacggacaaggtataataacagcactaaatgaaggctgaaatacataccaatacgcatatggacattctttatagatgatataacggctggaaccaatatgatatacacaaagaagaaataactattcattcggagagtcatttgaataagcactccattagattgaagtaacactactaataatgacaaaaaacaaaaaagattcatattctccattataagcttacttttaaaagaattaagcttattccaaaagatgataaataagattgaaatgcccgcaaaaatataagtgaatgagcttatatgagtttctcgatctcttgtcaaatacacaatatatggagtataggaaataagtttatctatagccaagctacccgcaatagtcaacaaaaacgcaagtaattttccttttatagatatagtcttatttaatatataatataaaggaataaaaactaaaatcgattcatgaaagaagaatcctcccaacaaaagagaaacgatatacttaaatatttttttttgttcaatatactttaatgcaacaataaaaacagcgattgctaagtattgcctcatcccattaaaggttgcaatataaaacggagaaatacaataataaataaaaactgaaatccaaacactgtaattatatcgtttaataacattatataccagtatttgcatgacaacagccattataaaaaacatgaattgatagctagccccgatatatcgcaaaaaatctagaatcaagttaaatcctaattctcgacttccatacccctcttcaagattatatattttcacataattaatataatcgactcctacataatacctaaacccagagaaaatggaaaaaagaataaatacacaaattagaaaaaagcgatttttagtaacacttcctaaagagcaaaagaccagtaagaaaaaatatataagaaaataaggaaacatcgacctttaccgcaaaccttttatatagtaataaaacaaaaaaagagaaactatacctgacaaaataaatgtagcgcacaaaccataaacaattgctataacaccccaatattgataaaatataagtgagaaaataatatataaaaagcaaaaagcataagtattatatccattccactttgcttttccaacagcgagtaatatattccctaatggattccgaaaaatatatgtaacaaatgttgcaaccataaacatcttatacatatatacacaatcattatattgtgccccaaatagattctctaccacaaaatccccatatataatcaataataaaaagactataaatgaaataggaattaccactttcagatagttataataatatcgctttaaacaattactatccatatagttcctagataaatagctaaaatcagagatcatcaaaattccaggtagagttaaaagattaaaaggtattatagtggcaaccctaaaacttgctatactgtgttccggttcatccaatatacctaaaagcaaaggagcaatagagaaaataatctggttagcaattgcactaacacttgtatgtattccatatccccaatattcttttttagaaatctcaatcgggttactaaattgtatataagagatttttttcctaaacaaaaagaaagtcaataacggtgctaatataagagcagtaatatagccatagttcttaaaaaacaaagtcaagcaaaccgtcagtaataataatataacagaattgtacacgtttattttagaataggttctatttaaattcacaattcggaaataactacgcattgtttctaaaatataaaagctatacaatcctagacacatataaacaattaaaagccactcattcttcataccctcaggtagaaaaaaagaataaacaactataatagcaacaacaattgaagtatagtttatcccaaccctttgagtataataataatactgtttttttttcaagaatgaattcacaattgaaccaaatcttaacaacgaataattccctccaaatcctgcaataacgattgctatggcatatatagacaatacgtaagataatattccgtagtcttctttagtaagtaattgcacaacaataatagaaagtagtgcggcacttatctttaccaaagctgtagagaaaaagacagaaaaacctcctctcttgataaaacctgaaataaaatctgaattaattcttttcattcaaaaaatccaatttataaaaggggctctcagaacaatataactgatcagaataaagattctgtgccatttttatatacttagaatttatatttgacattgcataatacatctctgcataccaagctctttgtaaatcactagattggatgtaattcaacagagatttattattttcaacaaagtcaatagctcgttctaatttatcccctatttcattatagtttaaaatacttgtagttagtatctctgtttccctattttttttgtagagattcagcaatcgagcaaaatcaacaatgttgactaactgataatctatatgcctatttaaaacagataaatccctggaaataaaaccattattaaaaaagacagtaggaaatacaagtttaaaaattataggatgaacaattttttcatatacgcaatcaatcaaaaaagaattatgttgttctttcaaaaataaattcaagcaataattatccattgcctgcaatttattcatcatttttcctttattagttaattccaaaagttgatttatggaaataagacctttgtttatccaatagtctaaatcaaagttaagaagatgttctttcctatagaattttagtaacagaagtgtattcaaagaatcaatatgagtattcaaggttaaagtattcctccaactcttacctgccacttttgatctaatatgtgaaaagggggtttttccaccatactcacttgaatcatggcaaaaccaaataccttctttccattcaaaaaaatatttaaattgttcatttgctatgattctgatatttttatctgtatcaaatccatcttcacaagcatacaacagcgttctcaatgcagaatttgtcgaacgaaattgtatatcataatctcctgtaaagctacgatgcaatagttttccattaccccaagttatacgtctatcaatggcttctattattcttaatttataatcagaaagagattctttttgagatttctctatctcacataatgcataaaacatactttccccactcatctcaaaacaccaatcggatcctaaacttcttgtaattagaaactttccatctaaagtaaaaatctgtttaaattcttcgggaaaacagatatcacctataagtgacaaacacattcttttcatttcagctgagtataaatagtgtccctcaattcattttgtcgttcctcagtaattatttcacctctagtaattaaatcaataaatttctcattaggagcataaagaattttacgctgctcgcatttatcaatatattcactaatagtggaaacaactcttgcaggatttcctgctacaacagaattagaagctatgtctttagtgacaacacttcctgagcctattatcacatcatcacctactacaactcctggtaaaataatactattagctcctaaaaaaacacgattccctattttagtcctttgtactcgatacttacctgtatgccaaagagtactagcatcatgtgccaatataatagatcctggtgcagaaataaaatcatcacctatttccactagttctggaaataatgtatcaattaaagagttactgtaaaaacgttggccatgcttaaatctcactctaggaggataaattaaatgatagaccttcttaaaaactttctttattatcatatcttttcatgtacaaatccagccaatcgtgaattacattattccatctaaacttgtctattattatatctgaattcttacaagtgagctttttataaggaacaaatttgttcaaaacatcatgtaattcatttgatattaattccaaacaatctattttcctataaaaaacgccccactgatctaaacaatcataaggtaaccacgaacctgttataactatattctgcgcacttaaatgttctaacatcgatccagaaagcatatctgtaggttgtagctgaataaaaatatcagatgcaactcttaaatgtgcaatatcttcatcagacaaaaattgttcaattacattataatgaaacttcgaattaagaactgttttttttattataccaatatattcggcatctttgggataggttacaggtaaaagaaattctaccttatcatgaaagggagacagcaaaggagatcgttctatattctctataatatcaatatgatgttgtaacctactagcattatatccaatagttattactattttgtctgcacataatcctattttagatttactaattcttgcatttgcaccactccttaaaatcgaaatcaaactttctaaaggttccaacccaaaacgacataaaacgatcttggaaagaaaagaactcttttgataacaagctttaaattcttctataactttatccgatgcaatagttatatgatctgctctattaaatagcacagtcatattttttttcctatcttccgatgcacgtaaaaaatcacttccccatattgaaacaattaactttccacggatatatttcgaaaagaacctaatatctcgtactattatattctcaacataatgaatatgaactacatcataaaaatcaagtcttttaatatatttacgaaacaatatatgttgataaagaacttttaagaaacgatttttttgaaaaaaagacggtactattaaagcataaatattattataaaatttatcagaaggaaaaaagagatctgaactatcttgagaaagaatatcaatttctaaatctgaattaagataaactttttttagagtcttcacataattgtatataaactgatgacttcgatttccaattattagaaccttcatgcctataataattgactatttattaataattgagaaatactcattccaattacctacatcaatccaagatttttcactaacaggaaaaacccctattcttctattttcttttcttagtttatctattagagaagttatatgataaaattgtccttctggaatctcatccaataagttgggttcaagaatatacagtcccgtatttatcttaaaagtcaagtcaggcttttctacgattgaatctaacagaccattttccttagtataaagaacgccataagctattggataatttttaagagccgcaacaacagtcaattcatttttattttctttgtgatacttcagtatctgactgtaatcttcattaattataatatcacaattggacacaaaaaaggtagtgtgtattttatctctcattaatgttaagctaccagcagttcccaagggcacattctcttgaaaatagtttattcgatatgacgaatctttgagagtagaaaaataatgtttgataacatctgctttataatttacagaaacataaaagttattacttccacatttaacaaaacgatccatgatatcctccataaaagttttttctccaatagggattaatggcttaggaataatatttgttaacggttttaaacgtgttccctgcccacctgccataattactattggaagatcaaactgatctattggagcattatcttcattggggaaaagctcactccacattaaaactttaacaagcttcctctcggtattcagaattggaataaactccattctataagacatcattaaagttctgatttcatcaaggcttaaagtgtcgtcagcagtaataattctatctcgtaaaatattcttaataggcgtatccaaggatttattaccaattatagcgcgttgaatatctccaatactaaccaaaccgaaatattctccttctgaaaacactaataaaagcttcctattacatttatccatttgctccaatgtatgcaatatggaaacatttatatccacaatcaactgttggtaatccatttctttagtatctattaataccgtttcctatatactcttaagctccctccattacttgtacacatactatttgcttctattactctatcaatgtaacataatgcatcaatctgacaatcatcttttatttcaagtccttgaaatacaaaagaatttgcaccaaataaacatccattcccaatttttacattaccactaattctggctcccggattaaagaaacaatcagaaccaacaacgacatcatgcccaatagtcacattgtaattaatcagatttgaatttccaataagagcattggaagaaataacagcattagcagccaaataattacccttacctaatatagctgaaggagaaatataagaagatggatgaatgacattatcaagtacactgttaaatccaccaaaaagatcaacaaaccgtaagcgtaaagttctgttagtaaatcctataatataatgagaaacctcaattgtagataatctatctaataaagacgagtctctaatataagtttgtaaaataggaggttcttcatctgatataacgttataaacagcaaaatatttatccttaaaaaactgatctacagtttctcggatttccaaggcagtactactaccaccaacaataaaaagagtaggtttcatcactaaatagtaccgttatcaacaaatatattttgtcctgttatagagcaagctttctttgataatagaaaagcgacagtttctgccacagaacgtacatcagtagcctgttttaaagaagtccttttgtaaatacgatctttctgttcttctgttaaagaagagctcatcgccgtttccataaaaccaggtaccaccacattagaacgaatacctaactgtccccattctctagcagtatctttggaaaatgcttctaatgcccctttactagaagcatacatagataaccctttataccctgtatgaacacttatagaagatatatgtattatacttccttgaatatgatgtaataacatattacgaattgcatatttagtcaacagcatcggagagaatacattcacgttatacattacccttaacttatctatttgtaagttggtaataatatcatcataagccacagctgcattatttacataaccatctaatgggactgagttagtaagaaactctttaaaaatgatcttgtgaatattggtcgtatctgagagatcaacacttttaaaaaagagtttactttcatatttttcttcaagtattcggaattcattcgaataactacgagaaactccataaacaacatgtccttcctccaacaaaactctacaaatctcaaggcccaccccacgagaacaacctgtaactaatatattcatgttcgttttaattttcctgttcttgttaatgctatattctccacaaattttattttacgtggaattttaaactcttgtaacttatcagccaaccagtgacgaatatccaattcagacaaactacatccctcctcaatctttatttcagcgcaaagaatattacctaaaacagaatttggtttgccataaacaaaagcctgttgaacaccatcaaattgcatcatgacgctctcaacctctccaggatttattttatacccaccaacatttatcagttcattcttacgacttttaaaacgaaataatcctttatcagagtcaatccattctattaaatcaccagaatggtaataatctcctacacatgaaaagctatcagatttacccaaaagagaattatgaattaataattcttcatcctcaactttaatcttatccttcaattcgactggaatctgaaataaatctccttttgctgcaaacaaagaaccagcttcagttgaagcatatatattatttattcgagcattcggaaatatcaaaagcattgattcataaagtttagtattagatttctcccctcctaaagtcactctacacacttcaggataagatttctctactggtaacaataaacgataaaaggtgggagtagcagaaatatgagttacatggtattccgaaagcaattcatatacttcaactcggtttttattaaaaacatttattaaagcatttttatttgcaaaagcctgaaaaaagacttgcaaaccagccatgtgagtcgggttaaaagcaaaagcccatatttgagaatgatatttaaaagaaactcttgtcgaacgagtcaacgtcccaatagtatgtactacttttttgggctgccctgtggtaccagatgtgaatatagttatttctgattttgaggttaaaacactatttatcagatcatctatatctgctttatcatcaaaaagaatattcctaggcttatttatatctgtattttctattccttctaattcattcattttagtatctgagtctaaaagaattagaggctgatcggaaatcaaagataagatcatattcaaaaagaaatcatataaattattcgtctgcatcagtggaatgtatgactttgcttcatttatccgttgcaacagatcttcataagtatatgatttatgttgatctactaaaaacagtcccatattaacgtaacttctcaattatttcaccaacagtatttactaacccatcctcgaaaatatcaatatcaaattcatcctctattcgaacggtaagttctgccaaatcaaatgaagtaaatccaatatcatctcttaaagtatcacttaagttaataacactcaattctgacaaatttttagctttccttatctcattgataataattaaaatcttctcttccatattttttataatcttacactacttggtatattcacaattctttcttccaaccacacagtattctccaaaccatccgtctcgcatccccgaaacatctcaagcctattcatcaattcccaaacagggcgggtcattacaccatggtcattcgtatattcaaggaaagactgttgggcccgacggtctttcagaagtacagcgttcaaccaatagttagaacggctgttcgcaggctcaacaacaaactcaacatcaggaatacgagagaaaaactcacggtaccgttctgctgtctcacgtttattgacaacatacctgtcaagattctccatttgggcacaacccaatgcggcattgatattaggcatacggtaattgtaaccgatatggtcatgaacaaatgcccaacggtgcggaactttggcctgggtcgtcaaatgtttggcaaacttgcccaactcttcgtcctggaaaagcaacatacccccaccaccggtggtgatcgttttattaccattaaaactgatggctcccactcttccgaaagtacccgtatgacggcctttatagaaactgccgatactttcggccgcatcctcgacaagttctatatgatattcgttgcacactgccgacaattcgtcaatcctcataggatgcccgaacgtatgcataggaacacaagccttgatacggcgtcccgtcttcttattataacactgcccattccttacttccgcatgcgtagacaaccacctttttacagcaagaggagaaagacccaaagtatctctatccacatcaagaaatacaggatgtgcgccaatataactgatggcgttacaggtagcgataaaagtaagagcctgagttaaaacttcatcatcacgctcaacaccgacaagaagcatacccatgtgcaatgcattagtaccactcacacagacaacagctctttttgagccggtataggaagcaacctgctcctcaaagcgatcgacaaacttgcccacactcgagacaaaagtagtatcaatgcattctgcaaggtattttttttcgttaccgataaataaaggagcgtgcaacggaacaaattcatccgtaccaaacaagttatggatgaaagtagttatattattatacatacttgtaaacattacattttctgatccagattctttcctttctccacgtgttcaaaattgggaaggaatcttttaagtgcagtcacgatatcagacttatggcaatccggaagggcaaagagggactccagctcatcaaagaaggaatccaattcagacaaaggacgtttactgacatcctcaatcacacccaaagaagaaaaacgttccaggttcaaccgctcaccgggcacatagaactcttcgtagcctttctcacccgtggtatcactttcaaaataaaccacagggtatatcttactgtcatccgccatttcggcagcatatcttctggcttcttcatctgtagcacactctttcttttcatagcccagagtacggaggaaacggtcacagatagaagaaaaagtgatcatcttttcctcacctaactttggaaagaaaatctctccattatttccaagaacacaggcaagcatacagatctgaccgctttcctcaggtgaaacgaaatagcgtttcacgtcattgggggcagccagaggctgtttcttcatgatacggtcaataaaaccggccaatagggagccattggaaaaggcgacattggcaaagcgggcagtagtgaccttaaatttagaggagtaggccattatcatatcttccatgatacgtttactggcacccattatattcacaggattggcagccttatccgtagaaacacaaaagaaatgacggggaggaaattccgataacagatcaagcagtttcttggctttgattacattattctcaatcaaggcctgtacagaatattcgtctttctcactccgtacatgcttgtgtgccgaaaaattggctacaatatcaaaaccctgctccttacggaacatccgttcgaagatgggatctgcaaagttcaaggtataagtacgatactcttctggaatatgcagcccataagtggaacgcaaatcacgggtaagttcggccaatccattctcgtttaaatcgatcacaacaagtttagaaggcttaaaaggaagaatggcttttatataggaagaaccgatagaaccggcaccgccaattaccaataaactcttaccttcaacctcctggcgaagacgatcactgtttgctgcaatatcgggagcaaacatgctggaacgacgaaaagtgatattatcgccaataaaattatctacattaagcatattttatattattcatcaaaaatgcatataatcagtcttctatctcgctacatggatacctattctcttccattatctgcaatgtttccatcacttccaattcttcttctgagagcgccctgcttttccagccatccattatttgatgtgcttcttgtgccaaatcttcctcgaatacctcgccatagcaatatgtcagcaattgacattttaatagagaagcggaaagatgatctaacacagcaaaagagcgatctaaaatgctttgtatcttagattctttgtcgccatcattgtaaatggtagcattataacccattaacagggatagacaaatcgctgcttcttcctcaaaagtggcacctttcatagagaaaagggcttcggacaagcgaaaaacttcggtgttcagttgacggaaatgatcggtatagatgggagagccatccgtaccaagataaagcaactcacgggcaatgtgttgcagattttggacttgattcatataattttgaaattacgaattacgctgaaagaatacgaaggtaacttttaggtactttgacgctggcagacagaaccccatgaatgcggatcaccacataggtgcgattggcaaggctggataactcaccttcgataccacaaaactctcctttgacaacctgtacttttgtacccacggtaagaggaaggtcgtcaaaagttacattttccggagctaaatccatcacaaacttaaagtcctccatctgcttgttggggacgatgagcaaagtatgggtataaagatccttcatataaaataaaggaacgtgatcatccttcgtgatggaccaggcacgctctttggtagtccggacaaaaataagattcttgataacaggaacttctaccctacgacgacgatatttcagttggcgaatgacaaattgtgtaggaagaaagtattctattccaagcttttctaaagcattacgaatagcaaactcctgatccttctttgtccgagcggcaaaccaatactcctgttgttcagacatttattgttggaaattaaaactcgataggttactttcgggtgcgctacgcggtttggacgagacatcttttctcattcaaaccgtaagtatttccgataatatttatagtggtaaaacggacgaaattgtttcaaaaaacgttcgtttataaacacaaaggtaaggcacatttttataacaacaaaatatttttataaataaattgcttttttctcttttttactaaaacacactactgataatgaaagagttatgaataaaaaatagtgtttttatctatattttttttcataagaacgggatttttcaaaaaggtcaaaaaaaggtgtttcaaatgacgaacgttttttgaaacaatttccccctattttttctataaattctacataacgtatatgtttgtagcccaataataggtatcccaccctcctatcacttacacacaagattttctcctcttacgcgcacgtaagcacatctgcttttcaaaaagatacaatatatttgccggaattatataaattattcaagtttcggaagtgtaaaccctcgtttatagttgacaaaaaagcaagtaccccagctttcacccgaaaagtccatccgtgaggcggagaagcgaatttcagacttaaccatctgaaaagcaacatctttaaaaagtaagatttctgttctcaaaagctttgttttaacatagagttaaagcttgttctttggatgcgaataacaaattctttaaatgcaaaagatttgttatttgcgcataagaataagacagtctaaaaaaagcgttaacaatgttaattgaagaaaggtataaggatgaagataccggttcagacggcataaattcacttctaagacttgggtgcactcggagcaaatgcgatgaatgtataacggaaagagattcaccacagggtttcacagagtaaaaatgatgaagaataaaactcagtgagactctgtgaaaccctgtggtaaatcattctccttttgccttcatcagttttccggctttgaggtcaatataataaagcattccccgggctatctccatacgcccgatttccttgtccggaaattcggctaacagccccaacaaatcgcccgtctcggggtcatagcgctgtatcttcccgctcttttgtactgacatcaggagctctccgccataggacagcagtcccaaaggctgtatggcgtcgtacttaaatacggcatcggaagtgatgtgtgtctcttcgccgaacacaatctccatttttgagggagtaaacacttgcaggcttttgttgtaccagtcggtgaggtacatgcgcccgttatgctccgccatgccatgaatgcggggctgatagtcatatccgattccttcgggtacctttacctttccgatccaggggacacgaaacgcaggctcggtaacagcttcataaatccaataaccgcgaatggtatttttatcacgcaccatcagcctctcaccgcattcgcgaagaccgtaacaatgagtcatgctgtaaatatcgtcaccccactttccatccgaacgcccgatggcattgacgaactgaagggtacgacggtcaaaaatgttgatacgggagttgtacatgcccacaaaaatataacggtccgaaacagccatatctcctatctcagcgttaaatgtctctttagtatctttccgcatccacgaatcgatgcgtccgatcagctcgcctgtcgtcaagttcaacaaaagaacagaacggtcggcggcattattgttggcaacaaataatgtatcccctttgacccgtacggaccggggagtaaaattggccggaagcactccgggaataatcacttcgccggcatcggtaaacgtggtataaaccggttcttcgggagaggtattgcctttatcagccggttcttcgtccttggaacaggatacacaacaggcagcagacagcaataataacagatataaaaattttaaattcatgtttacttattttttttgaatttcattcactacagggtttcacagagtctcacagagttttgtactctatattttcactccgtgagactctgtgatcctctgtcgtgagcttttttagtccaactcggatatttcaacaaacatcacttttccctgtatcaggcgcggagcgttcgcgttccgacctgaaagatagaacatatcgttatggaaaaagaggcgtcccggagtaccgaatcccattcctccggcaaaagaagagtaagcgtccttctcctctccggtgaggagattcactcttacgatacggttattggcacagacaacgtacatttcatcctgaaagaatcccatactcaacggcttgctttgcatacggtaggaacggacaaagcggaccggctctcctttcgtagtaacggtggagggatcgattacgaggatacgcgaactttcatagtccgatacgtaaataagttccttgtaacgtgccacggtctcgaggttaaatccattgttggaagttgtgctgtcggtgttctgggcaaacacggggaccttgaaacgattttccggtgtacagtccgaaagctgtaccaccttgattttttgtttatcacgaataaacagtttgtcaccggctacttcggcagactcgcattgcaacaacgagctcgactgccaacctgtacgcccgatagtggttacatacgtataatcgttccggcgaaacatgtcgatccgggaagagcggttcaccacaaaaatataatcgctgttgacggctacatccatcacttgattatcgaacttttcagcttttccgtcatacgtccaacctgtcaacgagtaaagcaattcgccggtggaggcacgaacaatccggacaccatccgatccgtcggcacggttggctataaaaagggtatcacccgaacggcgcattcccacaggattatagctctgtgtacctacaccgatggctgccgcatccagctctttctcaaaagtcagtgtaaggatggaatcggtagtgaaaccgaaccccggcatattgtttttatcacatgcggcaaaagtgagcagcaaagtcgccactaccataaaaatgctgtatcttttcatcataactctatgtcgggattatcggcatcgttgataccggggttataatcattgtaactcttgaatggattgatgacataaggcaacatccggtgtttcatcatgtaacgatatactttcggcacaatctcgtcgggcatcgatccataacacaagctgctggaatggccgtaacccagacagtgtcccaattcgtgaatccagacatgaagcacccaattgcaatctatcgctacccggttctggtaaaagaagcccgaaagatattcctcacgcaatcccagtgcgtttcctccgccaagtccggcgattccgggtccggtgactactccgaacaccagactttgcttattcagaatggatttcaacaatccctcacggtcaatctccttccctgcatcgttatggatgctgcctttataattcatcaatgaatcacgaaaaattccggaactgaacataacggccatatttaccgctgaagtggcataataacgggctgcattgggcgtcatcactccccagttaccactaccgtattttcccatctgaatgcgggtcttcatcttgatggttttcaacatatcgaatacagaatcgttgcatgtaagcaacagttcgtactgatcgggagaaagcaaagccagattgttgacacggacaggcttgccgcttttggagggatagactgcctcgcccatcttcagcggagaatccaaccggatgttgtaaaagcccggaacttcttcaaactgcatcagatggatggtatcatgcaaatggggcatcgtaagccatacggagacttctttgaaatcgtgagccataccattgaacaggcggagctttccgtctgtcatcgatacattaagcggttggttcacataaaaggcacgatcggccgaaacaatgtcatcaacgctctcaccatcttcaaacatctgttctccctgattgagaaactcctctgccgaaattttagtcaaggcaggcggtgtgccaaaggcattgagaatgtcaacggtatcatcatcctggcaagcaaacagagagagtgccagaagcgaaatacctaaaactttctttttgttcatagtgtagggtttatttgttttttgagggcgcaaagataatacaaaaagggaaaatgcaaataaaggtgtccaaatactgtccgccaatcgacagagaaaccgcatctcaaataaaaacaggcaaatcttatccgatcccaaacgattctttgtaaatttgcacatacttatttattagacaaaacattatgaaaaaactctttttatgggcactgtcagccttgttaacctttccggcagctgctcaggacttcgtccccgaagcttcgttttacggcgaaaactactggactcccgacacactgggtaatcaccgtgccgttgtttcaatgaatactcccgccaccgtagcggaagcttatatcccctggcgcagacgcgacgccaatcccgaacagaaagggattattgtgataaatgcttctaccggcaaagtagtggacaatgtacttccggtggaaatcaaccgtgagtacggacgtatccggttcgatgccagtacaggtacagggaattactatgtatactatctgccctaccatacatcgggaggtccataccccaaagtgaactatccgaagcaacctgacagagccgacgcacaatggaaagcaatctgcagttccactccgggaacaaaggtgacccgggccaaactggtcagattcgagtcgttaggcagtttcaacagcttctatccgatggaaatcattgccacagcaaaagagaaacaggcattggcagaagccaatagcaataaaccgttcctgctgctacccgaagaccgtaagttccctatccgtatgttcgacgatctctcgtaccgtcaggtaacccaaggagccaccagcgaatttttcggtgaagcagacttaaacgaatattatgtattgcaactcggactatgggctttcaagaatccggtgaacggggtcaaagtaaccttcaccgacctgaaaggtaaagacgggatgattccggcatcggccatcacttgtttcaatacggaagggaccgactggatagggcgcccgatgcatccggaagtaaacgtgggcaaggggcgtgtacagccgctttggataggcattcagatgccggaacatgccggcagaggcatttatagcggtaaagccattgtcagcgattcatcgggagcctctcaggaggtaaagatcacgatcaacctgtccgacaatgtgttggtagacaaaggagacagtgatttgtggcgtttgtcacgcctgcgctggctgaattcacaatatgccgtaaacgaccaactggtgaagccgttcattccgatgacggtgacagacaacacaatcagcgtattgggacgaagcgtcactgccggcgaactggggttaccggcttccatccggagttatttcaccgaagagatgacctccgttggcaaagaagccaaagacattctggcaaaaccgatggagctcgtcatccgccggaatggaaaacaactgcccgtcaccatcacttcaccgttgaaattcggcaagaaggaagacgggattgttagttggacagctgccgggaaggccggaccactcgatgtgacggtacatgccagcatggagtttgacggtttcataagttatcagattaaagtaaaagcaaccgaaaacacatcggtagatgacatagctctgatgacttccatgccggcaacgactgccaaatatcgtttgggaatgggatatgaaggttctctgcgtcctaaaagcgaccgatggaaatggaatgtggaacgcaatcaggaaggtttctggttcggcgacgtaaacggtggaatgcaatgcctgttccgtgcggaaaactaccgccgcccgctgaacaccaatttctacaaaatgcaaccgctgaacatgccgccatcctggttcaacgacggcaaaggaggtatcagctaccgggaacaagggaaacaagtggatatcgaaacctacagcggaaagcggaccatgaccaaaggagaagagctgaacttcgacttcctggtgctggtgacacctttcaaaccgatagacaccatgaagcagtggaccgatcgctactatcacggttaccagcctgccgaaaaactgaaagagggtgatgcgcatgcttatcaggcggtagacgtagtagccgaaaccggagcgaacgtcatcaacctgcatcacggcaatgcagtcaacccgcatatcaactatccgttcttccgtccggccttcatgaagcaatacgtggacgaatcgcatgccaaaggttacaaagtgaaaatctactacaccgtaagggagctgaacaatcacgcaccggagctttttgccctgaaaagtctcggacacgagatcttctctccgggcaaaggaggaggatatgcatggttgcaagagcatctggacggtgactacatcgccgcatggtttgtagatgcctacaaagatgcagccatcgtgaataccggcatttcacgctggcataatttttacgtggaagggctgaactggctgacaaagaatgtaggtatcgacggtgtatatatcgacgacctggctttcgaccgcaacaccatgaaacgtatccgccgggtactggaaaacaatcgtcccgacccgcgcatcgacgttcattccgccaaccagttcaatccggcggacgggtacatcaacagcatcttcctgtacatggaacacatgccttacctggaccgtctttggttcggcgaatacttcaaatacgaaaaatcaccggaatactggctgacagatgtttcgggtatccccttcggcatgatgagcgaaatgttacaggacggtggcaatccttaccggggtatgctatacggcatgacagcacgcgaaccgatggagtccgtcccttcacaactctggaaggtatgggatgctttcggtatcaaggacagccggatgatggggtattgggtatcatacaatccggtgaaaacaggacgcagcgatattctggccacttcgtttgtcaaagatggcaaagtgatgatagccattgccagctgggcaaagaaagacagtgaggtgaaactacaaattgactgggagaaactggggatagaccccgacaaggcaaaactgacggcacctgctatcaaaggtttccaggaaggattcacactgtcagccaaagataaaatcaaaataccgaaagacaaaggctatatctttattctggagtaaagatagataaaatcaatgaaggtgtgtcgagaatgtctccatgcggaattgacattttcgacacaccttcatttaaaatatgattgacaccttcagcaaagctcacaaagcatatccgaatttacattttcactttttgagtatcctctttaaatagtcgacatccaacaataaattcacagtctcaaactttcctttatagaatacagcccagttattgaaaacgcagggcaattcctttgctttttgtaacgtatccacttgaatgaaagatacgggaacgtcattcatttcgcaatactgttttattatttcaatgttttgacagatatagggacattgcatatcatagtaaatcgtcagttctttgctttcaatctcctgcttctttacattttgcgcaaaccggggtattgttccgtcaaaagaaagcgcaagcaattcatatccgttatcagtagtatcaacaacttcaaaaccgaacttcttcgcaaatgattggtcagaaagccaggatttttgtttttttgctcccagcatacaaataccggatttaccctttgctttggcatcagccaaacaatactccatcaatgactttgcatacccttttcctttataactacctaaaacccataagcaatatacgtaataatagttatcaccggttatggggacccaagctgtttcaaggggagcatattcgataaaaaccgtagcctttgcattcaattttctaaagacgtggccttcattcagccgatcagaaagccatcgccgctttgcttcaataccctgatgtggctttttactgcggataatgcaacataaatgctcaccggcaagattttctgttgtcaaatttacaaaatcagtatccatacgcaccctcactttaaatttagatattatcaaccaactgaccgggatagtgccactttatgactattattaataaatcacaaagcaccaatgtagtgaatttaaatgaagaaacttcactgagggcttccttcataaaaaataattttatcactgtcttggttctgcataaacgatatagcgtgccgaatcgtcttcgtcaagtaataaaaccacattggcgttatctgtaacccatatggcgcacggataggcattcggatatattttttgctcggaaaacagttccttatataatcgaaagatcttttgcttatcctttttatcttcgtaagtaggttgcgaatagaatgaacagaagtagttataaagcacatcatagctttggctcagatatttatcgcttgtaacattaaagtatgcaacttccactgatgggacaccagcattaaaccgataagtagtcatcaaatcagggttactgccgataacatcaacataagaagtccacgcctgtgaagtattagtcacatccttccaattaaatcccagaaaatctttatcattaatgatagtaaccgaaagtatgtcttggtaaagcaccttgttatccttccatgctgtaaggcaagtttcataatctccggggaatataaagcagtgcccccactccataaccaaatggctcttaactactccttctccactttcacgttcatacaaccgatagctgcctttctgtccattcactgtccagactattgaatcgcatacctctgacagtaatcccatcgttatagattgcgaaccatcatttgttagataaaaatccatacggtcaaaaacatttttcctattcccttttttaagtgcaaggtgaggcatcggcgctttggtcacttccacttttatcgtggcagtctctcctgtttcatgatcggtaacgataatatcggtttctccatcccgcttacctgtaattttgatatcagaggcatattccgtatttccaccccatgtataaacagcatcagccacttcaccatcagttatatccaatgtcgtgttttcatgggccgtcagctttacagattcactaccgcccaatatgattttgcatgaatttacagtcaactccaaatggcaggcagattccgtttcttcattgttgcaaccaataagattaattgtgcacaagaacaacagtagtagttttgataactttttcgttttcatttttttatagtcttgttttacctttcatgaaagtacttgcaaatataagaaaaatgcaatacactctactatgtactgcatttttatatgtcttacgacatattatacggaaatatggaatcctcatctgtcggatatgctcaaatggcttgtatatggatttagaggattgtgtcctattatctattctgcaacttgctccctaatattttttgctgcaatagtgtggaaagaatgaatttattggttcccagattggaatccaacaaagaaaaatcccttgaaagcacttgactttcaagggatttaaagtaatgttcgaggttcctggcggattttaaactgccaagataatccttttatttccagttgattagaatctctttagcttcgctactgtaaaacaaatattctgtttaaatcgtttattaataatcacaaagataaactgataattttgatttgcaaagaaaaaatggaaagatttattctatttcttcattaagccataatagacaagtacttttgcaaagcagctatctccgcttcaacaaccaacttttgaaagtcttccggcaaatgttctgtatgcgacttctctaatgccatgtaatagcttacctttgcatcattactacctttcagagtaataataacatagccatgacgaagaagatacaagttcatcaacaaacgagaagtacgcccattaccatctataaacggatgaatccgcaccagttcgtcatgcaggtaggcagcaataagaacaggatgtatcttttctttttccatttgcttgaaacgaagaataaaatcttccatttgcttctctaccagatacggttgcggtggcatatgtgtactaccagaaatcataacaggaacggtgcggtatcttccgacattttcccggtctattccatgaagaataagggcgtgtatctctttgatggtacgttagcttatctctatatcttgtttagcaatatctttaatatagctgatagcttctgcatgattgattgcttccagatgttcactcatggatttccccgaaatagtaacgccttcgtttaccacaagggctgtttcctgcaaagtgagcgtattgccttctatacgattactttcgtaggtgtattcaatatccaaagcatcctgaatctttttcaaggcttcttcgggcaatggacgcaaagctgatagctgttctttctgaacatccacctctttcagcataacatttatatcttcactcatggttattctatttctttaattcgttccacttgtttattcaggaagtaatcggcatacggagaataatttcctgtttcataaaagccaatcagccctttcctgtaattcagtatatcggcatcccttgaagaataaacaggaataatatcagcattcatcaatacaatgctttccatcattcgcgaggtacgtttgttcccgtcaatgaaaggttgcagtttggctatgttgcaatgaagataaacggctcgctccaatgggtttgttaattgctcttgctgataaagtatttcattcaactttgcccgaatatcatgcaaatcctttggcggtatatatcccgtgccgctaatacggacagcccttgttcttaaaaagcctgattcttcatcagaaaccaaccctgtagatatagattgatgcaccctaaacaaagtgcgttcatctatcacttcctgatttttccctttattgatatactccagttcagagatgaaggtattatataaattcttcaacatcttggcatcttcatacttcttttcagaagtaataccatctttgagcaatgcttctgtttctacataagtatatgtattgccttctatcttaccggaatagtagcaccatacaacggctaagtcctttatttcatttgagcgcaaatccgatagctttgccaaaggatgattcaaaatgaattgcgctttttcctgttgctctttattaaatatctgttccatagtttatggtcaaatcttgttatttcctataatactcttactttcataatacttaatcctgcctttaagttcatcaatatctttcttaatggaatcagagataggaatattatgcttatccaaaaaagctgtgagcttttgaagttcttcctgtacttccatttttcggatgccgtaataataggtagaagtgaaatcaaattcatctttagtcatcaatacccgtgccacatctttaggagtagtcttgtcggtgatatgaatatctgtttcaagcatcgaagatatatattttaaatccgaagcatcaggactatactgtttttttagtacatcgaaataggaattaaacttttgttctttagcatcccattcaagtttcaccattccaaagccatgaatcgagtaagctatcacctttttaataagcccttccatttcttctttactgatgcaaacaccatctgatgtgccagtagaatagctatcaaagaaataagcaggttctacattaaagtattgaaccatacttaataatgtatctattttagtagagttagccttgatgattttatgcaagctctgctctgtcatgcccaattcaacagcagcctgtttcattgttacgtttttcttttcgcacaactcctttattctttcaagatgaaccatataagtgtatttaaaatacaaatgccaaactattaatttagccttaatatattatttctatatttgcagcatcaaagataagaaataaaatttagtgttcaaataataaacagattttctaactaaaaaagtagaagtatggaaacagtaattgtaactacagaatccgctatcgaaaagataatggaaagagtattagataaaaagttgccaaagcctcctgaatcggatatagagaagacttataagtattaatcaagtagccagaatgatgggacgctcacacaagaaaatttcagaccttgtggcagcaggcgtactaaaggctactgctgataaccgtatttttgagagttctattaaagagtacaaccacaagtaaagctgttcactaaactaaaagttgaactgaaaattctttttcatccaccacttgaaaaagcaaggtagcgtttctgcaaagggacgctatccaacaaatgaactgacatgacaatacccaaagaaacaaatatctgtatatcagagctaaaaaaggaggatagctttccttaagtacttcatctctttttttgtatatatccgcaaatttgaaattaaataaaagttcaaaatcattagctaacatactaaaaggaatattttttccatcaataccattaatgctgtttaaataataaagcccacaaatattttccataacatcggtgtaattaataacactcggattcagatataaagaagattgccattttctttctatattaatgaaatattttggatattgcatttggcgatatattagctctaattctttgttaatcaacaataaaactttatctgaataaactatttttaaaatatttcctttattcccatatgataattccaaagattttatcatttcaaattctacttgtgttatattgagcgtacgaatacgttttctattatcgttttctgtatctaaatataaaattaatgtttccataaattctttatatacatcttttaattccccttcagaatccgagctacttttatataaaggatttgataatattgcatatagtttggtgtcaagaatatctcacatagctaaatgtttcttttgagatataatagcaaggggggggtaaatttcaaaactgaatatacccccttgctgctattatcttttcttttttaagattttcttttacttattaattctaatctgtctaaagcaacagtgcttttaagtaatccaaaggcaactatcacttgcttaccttgtatctctaaaacatttccggtagcggcttgtcccttcaatctaacaatatctcctttttcgattatggtatttttcaaggattgttctttaatcagtttacctgtcttcattgtagcagataaagttgcttctttcccaagttctgaattacgattccctaaaatctcttttcttctatcttcccaaaaaatcttatcacgggctatagactgtaaaaaactatccatattaataaaaccttctcctaactttgcggaggattcgataataatatctttcggtaaaccaatccgtgttgcgacctcaacggcaaaagagctacccggattaccaatagaaagtctataaaggggttgcatacgttcagcatcgtaaagcattgcgccattaataataccatcagtctcataggcgaaatgttttaagttttgaaaatgtgtagtgataactccgaagctgccttttcgattaaatctgtcaagcaaagtttcggcaatggcgccacctatttgtggctctgttccgcttccgaattcatcgattaagattagcgtcttattatcgcattgctccacaaaatacttcatatttgtaaggtgtgaagtatatgtactaagactgttctctatgctttgtccgtcacctatatccacaaatatatggtcaaatattccggttcgtgaattttcatgtacaggaataagtaatccacattgtaacatatactgtaggagtgctactgttttcagacaaagagactttcccccggcgtttgctcctgaaacgattagtaatctatttttttcgtttagaacaatatctaaaggatgcgcttgctttccctgttgaaatagctgtatgttcaataagggatgtatagcttgtgcccattctacttgctgtttgttctcaaaaatcggtttaatgccatttatacgtactccaaataatgcttttgcacgaataaaatcaatatctcccataaaattgtatgaatgggaaaggtctgataaatgcgggcggataaggtctgtaaattttataagaattttcacaacctcacgacgttcatcggcttctaattctcgaagtcggttgttcgcttctgcaacggcttcgggctcaataaatacagtttttccactccctgaaccgtcatgcacacatcctttgatttttcgtttattagcggcatcaacagggattaccatatgtccgtcacgcaaactgatacttgcatcttttcctaataaaccagctttctgggcatcacgcatagcattttgcatattacatgatacagcttttgttgtttccatcttatttctgcggatatctgcaagctgacgtgaggcattatctttaacttggtgtgatgatttatctaatatagagtttgccttatctataattacaggaaaaattttgatattgtctgccattatagttaaagcagggtatttaaactcccctttgtctgtctttgccgcatgcaaatagtttactatattattgattgcttgcaatgaattcattaagtttgaaatttcttcttctgagagccaagcggtaacatcattctttatcttgtgtaaagaatcacggacatccaaaaaattatctgtaggaaaatcctctttatttcgtataatctgcgcaaactctcctgtttgctctaaccatttttcaagagtggcaaagtctgttgagaaactcatatttgttactttctcttctccaagagggcataaacacttttctataatatattgacgaactgtatcaattccaattctctgttcaaaattattcgggtaaatcataatctcaaatattattactatatcagctaccagccatcagtaaactgatagaccaatatacagttgataaaaaataaattaaataaaactgagattgcccatattccgacaagatactaaacttctgatagacaagggaggcctatttagtaccattgacatctcaaaggttagagatgcgaactcgcaatatggtatttacacggaagcacaacacataaatcgtgaacattttaaattatcggttgcaaaggtaagaattatatttgaaacaacttggaaaaacacaaaaagtcttgtatttcttatctcaatcaatatgttaggttgttactttttaaaaaaactgacaaaaaaaaagactaactatcacttttttcttcgtcagttttattttatccgcactttatttacattatcaagtaacagatttacagcatattatttattaaaatgcagaaagtgtggaaaatgcactcatattaccccacccacttatctcgcatctcctttacaatatcctcatcatgcaagtgcgtataaatatccttgatgtcgttaccttctgcgtgccccattattcgttctgctatcccgtcacgaatacctttctttgcagcaatagttcggaaactatgccgtgcccggtgaaaggtcattgtcttatcaatcttcaaatctgccattatatctttcagataacggtttgtcggctgattggagataggcaagaaaatcttttggcacggttcaccattcccaagcagagtatgagtgattccgagattatggtgattttgattctctttcattcgggtggttttagatgcttcaagcattattatccggaatatgtgtgcaagcatttatcccatttgtttcctgttcgggtttcctataaccgctttgtagaattggaaaaagagatccttcttccattggctatatttatcaaacaggtgctccttgggcagtgtacaggtattagttttgccgattccactccattacgggtttgccgtaaccaacgtatccatattcataaaacctttgaaggattagccacacgtggaaaatgttcaatgggatggtttttcggcttcaaactacacctgataatcaatgacaaaggagaaatactgaacttcatgtttactcccggggggagtggatgacagggagccacttaaacaggaaaccttctttaaaaatatcaaagggaaaccatatgcagataagggctatatagggaaaatgctctttgaaactttatttgtcaatggagtgcaattgataactaaggtaaaaaacaatatgaagaatatgctgatgagtataaccgataagattctattaacggaaagagtaatggtcgcgtctttgattcgcaaatgcgtcttttagactccctcgcacagtcagacatgaccaaaaagcccgaaataaaaaaagaattcctgatcgatgccctgtatacgatggatgaatctctgagaaaataacaagagttgaatgaaaatatgcagaacaaataaaaaaacactctcgcacaaaaaaataacggtttgtttatttgcacaataaacaaatcgttattatatttgcagggtgttaatgacacagagatgtttgataaggttgaaggtctaaatgaccgtgaggaaatgcttgatcatttgaggttcctcatccgatacgaagaagaaattcttgaagatggaattctttattccgaatcggaattctacgatgaactctacagcaccattacaatgattgccgagagcttcaacgaagaatgaaaaaggtagggattcataatgaatccctaccatcaaccttatcaacatcttctttattacagattacattaataatattgcattatggataagcagacggaaaataagattagaggccttgtagatcaattccacctcttacgtaccaaagaaggtgctatcaaatttgataacatatggaaagagctgactgcatccatcccacttgaagaacgtagcgaagcgggaagaatcctccgtgaagagatgaaaagccggagagagcgaattagacgtactgatattgatgtacgtaatcagatcggagatttaggagacgttatttccttatcatatatcgctcaacactacttccaaaaagataggagctggttagctcaacgcattaacggaaacatcgtcaacgggaaacccagtgcatttacagatgatgaattagaactattcaagtttgcacttaacgatataaaaaataagctatcggaaaccatattaaacatcaaatgacattaacacaaccgagagagggaagccgatactccctctctttttttatttccaatcattgctgtcccattaaaatctaaaagagttctttgaaatatttgaaacttagttagttacagcgattttccgagcgaacggacttgaatttgtagctttgcatcagattaatccgatagcatatgttccaagacaaatacgttttcgctcaattgacttcacacaggtagcaaacggaaaaacgacagcttatgaagggttgtgcagacttgaagacaatgtatgttcaagcacccgcattctcaccgaaattgtttcgatactaacgatatattggagtataaaacattagcacatgggaaaggtaaaggagctaaactggattttaagcctcagcctattaagaggatgaagaaaaaacaatgtttctaaagaaaaggtgggaacaaagtggcgcatggtaataaccctgtgtatatgtagtaaaacacttatctttgatcactaaacgcagtgcgatggaaaagaatgcttatatagagctggctgaatgtcttctgcctgaagaaatgattgaatactttgaggtggtcaaggtagataaaaccacagaaaggcttgacgtaaccttggaggaacggaataatggggttttcggttacgagtcaggacagcttcggtctaacggtttctatgaagagagcatcgttagggattatccggtcagagggcgtaagatgtcgtttcatgtaaagcgtcgccggtggattgaggttgagacgggtaaaagcgtcagcagacgctgggatttagtggccgaaggtacccgcttctcgaaagagtttgcggtttttttaaaagatatgcttggacaaatacccgattacgggccgctctcttgaatgttttttcgatatagacggagacctgtttgaacgccagtataagcgtcatctgagcggttactggcaatggaaagacacggcagaggggcttcatgccgaacgatggcgggtatttccgcaaaacattgggccgcatctgagtatcgacgaaacctctttgagtcgcggagagctatatacaatcgtgactaataaggaggctcacggtcgagagaactccattgtggccatagtactcggcacggaagccgataccgtcatacatgccttgcgtcaaataaaaagcgagctacgcaataaagtcaccgagataacgcttgacttgtccgacagcatgcataaaatctgccgtatggcttttccgcgggcatcgcgggtaatcgacaggtttcatgtgcagaggcttgctttggatgcagtccaggaaatacgcataaagcaccgctgggaggccatcaatgccgaaacagatgccagagaggctgcgaaacttgaagggcgaaaatatacagcggaacgtatagagaatggaaatacgctcaaagaactgttggcaagagggcgctatgccttattcaaatcacctgaaaattggactgacacccaacggacacgcgccagaatactgttcgatctctaccctgatttgaaacaggcttattggctatcgcaaaacctcagggtcatattcaacaaacaatcaaccaaagacagcgcacgtctgaatctcgcccgttggtacaatcgagtcgcagactccggcttcaaatcattcaacaccatagccgctagggatcaatgaataactctgaggggtgaaattataaattcttatctttgccttcaagaaaaaagcagagcattttcaaacaaacaagcggggatatgaaaatgctttttaaagggaaagcagacaagaaacaaaaagtatacttctgaatacgagggaattaggaaagtttttcaagcgatggcagagggtggaagatggaagatgagggtggaagataaacgggctgaaaacgcgatcttccaccagggtaaataaatgataatcagataaaaagattgaaaaaggtggaagatggaagatagaaatacatttcacggatgagaggacagaaaaggcactgtccacgattttacccctattcaaccgtattccaataaaaaagagcattttccgaaaaaacatattaaagaaagatgcttcacaataagcaaaataaaaattaaaactactctcctacattgcaaactatttagttatatttgcaatctaaacatatcttatactatagataaaagaaataagtccgctaaaaagaatgcagcctaatcatctactggaaacacagaaaagcttttcagacatatattctatatattatgtaagaatgctccgcttctcacaaacctatgtcattgcagaagaggatgcagaaaacatagtgcaggatacctttctttatctgtgggaacatctggacctactgaaagacatagaacatctggatgcctttcttttcacactgatcaaaaacagatgtttaaactttctgaaacaccagtcgtatattcaggctaaaacctgttcactgaaagcagacgaagagttggaatatcaactgaacctatatgctttggaacagttcgacgaagctgtctcctccattccggaagtagaaaatctattaagccagacaatgcaaaagttacctgaacgttgcagagaaatttttctcctcagccggatagaaggattaaaatataaagagatagccgagcgtctgaacatatccgtcaatactgttgaaaatcaaatatctatcgcattacgtaaactcagatcagaacttaaagactatcttcccttacttgtttttattatttagaagatttttttatatttcctttggtggtaaatgcatccccgattgtctttactgtaaaaccactcaaggaaccatgaatgatgaactaaaaaaatacttcacaggtgccatgtcagccaccgaaaaagcggaatttttgaatagactccggaataatccggaagctaaaaaagaatttgcacgcatgaaagctgtatgggccatctccggactcacatcacaggaaggagaccgggaaaagaccgcaacaggtatagctgaattcgacaaacgactgaaacgacgttctatacgccgcttccgtatcgggcttttaaagtatgcagccgcaatctgtctgctggtcaccactacctggtttattagcaacagatatgcacagatcggacaaaaagacttatatacagaaatcaatgtccctaaagggcagcgagtcaacatgactcttccggacggtacttccgtatggctaagccctcagagtaaaatcaaaatccccaatgcattcaaccggaagagccgtacggtagagctaaatggcgaagggtattttgaggtgaccaaaaatgccaaaaaaccttttatcgtaaaaacgcaacggttcaacatacaagtattgggtacccgattcaacgtattcgcctatgccggaaaagagaataagtttgagacctgcctcgtagaaggccgtgtgttggtctataacaaaaacaacaggaacgagaaggtatacctcaatcctcacgagaaagtatcgttggtaaacaaccgcatggtagtatcgacctctaacttcgataatgaagaatacctgaaaagcggcatctttagtttccgttcaaaacccttcggagagattctgaattacctgaccctgtggtacaacgtacagttcaaattcaccggagatgtgaagctggatgaacgaatctccggtaaaatccggcaaagcgaggatgtggacaatatcctgatagccctgcaaggagtataccacttcaaattcaaaaaaacagatgacgagcattatgagatttattaaataccaatgtctaacctttaaaaacaaatcagcactatgacttaaatatttttcaccccaacaatggatagtgtgacaaaaaagggtgagcgctaccaacactcacccccgaaagagtcaatactatcttttatccatctcgaaatagacctatagtattaatctttaaacgtacgacaaagttatgaaaaaaaacttgttgcagaaatggtatgtccatcaacaacttgaattaacacatattatacgaattatgaaactgtccgtgttctttatattcgtttttctctttcagctccaggctggtaacgtaaaatcgcaggaggctcgtgtaactctctccaagagtagtctgactttcggtgagttaatgcgtgaaatcgagaaacagactaattatctgttcatgtatcgtgatgccgaaattgacctttcacaggaagtcgaggtaaaaaacacccatgccactgtgacggaaatcctgaaaacggcactcagaaacaaaaaactgacgtataagttctccaataactacatttctctgtatgtagacaaagaaaaagcgtccgaaacgacaatcacccagcaagagcgcagaatcaaaatcaaaggtgtggtgatcgatcagatcggtgacccgattatcggagccaacatttcgctgaaagggcaaccgggaacaggagatattacaaacattgaaggaaacttcacgctggaagtgccagagaaatcagtattagtgatttcatacatcggctacctgactcaggaaataccggtgaatggcaaatcgtctttcaatatccaaatgaaagaagacactaaaacactggacgaagtagtggtagtaggctatggctcacagaaaaaacagactgtgactgcttcagcctctacgctaaaggtatcttcgctcaagaatgtacctactgccaatctggcctcctcactcggaggacgtgtcagcggggtgttgatccagcaaaccggcggtgaagccggatacgatgacccgaccatcattatccgtggttccagctcacctacctcctcttctcccttgattgtagtggatggtatcatcggacgcagtatggctcaactcgaccccagtgaaattgagagcatgacggtattaaaggacgcctctgccgtagccccttacggtgcacgcggagcaaacggtgtaatccttatcactacaaagcgtggtaaaagtggcaaagcacaagtagactataacttcaaagtaggttttggtacccccacccgtatgcctgagattgccagttcttatgatcatgcacgcttcatgaatgaggcttggcgcaacaaagaaatggatttgggcgaagacccgggtatgtatggcatttataatgaagaggagttacagaagttcagagatggttccgacccctacggttatcctaacacggactggaacaaagaggtattgctccctcgcgcctggcaacagatgcacagcctgacggcaagcggcggttctgataaggtgaaatattttgcaggattcggctatgtgaaacaggatgccctctatggtgacacacgtaccaatgaatcgacctccggtttcaaccgatataacgcacgtgtgaatatagacgccaacattgtggacaaatacctgaatctatcggcagatatggcctatcgccaggaagacagaaacagtattgccggcagtacttccgatgtattcaataatatgcaccgcaacccgcagacagatccgggacgctttccggacggcaacttaggtaaagtgtcactgggtgtcaatcctatcggcctggctaccgaaggaggttgggtcaaagatcgtaaaagtgtattaaacacacgcttcatgttggatttcaatgtcccgggactcgaaggcctgaatctgaagggtattttctcctacgacaaaatattcaacagcatcaagagatggaccactccggtagacttctatgtgtggaacaaaattacaggagaatatgacggacactcaccgaaccgcgaaggtgcggaactgaaacaaacgtactctacaagtcaggccatgacgtttgagttccaggcagcctataataaaaccattgcgcaggatcatcaattgggagcattatttgtattctcacgttcggaaggagccgacgaaaacttctgggcctcacgtaccaaatatcgtatttattccatccagcaactgtttgccggaccagacaaagacaaggataatagcggcagtgcttccgaaaccggtaaaatcggttcggtattccgtctgacctacaactataaagagaaatacatgctggaagcgaacggacgcctcgatggttcggaaaaattcccgaaaaacaaacgttatggcttcttcccttctgtatcggctgcctggcgtatatcggcagaaccttttatggaacccttctcggaagtgcttagcaatctgaaactaagaacttcatggggacgtgccggcacagacaacatcggacagttccaatatatgtctgcttatggtacaggcggcgatgccgtattcggcggtcagaatccggaaatcgctccgggatatactgagacccgtttcccgaatcctaacattacatgggaaacttctgaaatgttcaatatcggtatagatgcctcgttcttcaacggaaaactcaatctggaagcggattggttctataaaaagacaaacgacatcctgcgtgaacgtacagatatgccggctatcctgggatataaattaccggctgccaatgtaggtaaagtagacaacagaggtatcgacctgaacattacgcatcgcaatcatctgcgcgatttcaattattccgttgcaggtaacctgacctgggccagaaacaaagtgattgacctgctggaacctgccggagagaaaaacaacccgagacagcgcagtaccggacactccatgagtcagtacttcggttacgaagcactgggactgttccaatctgacgaggaagccaataactggcctcaaccgcaattcggcaaagccaaggcaggcgacattaaatacaaagaccaaaacggagatggcatcatcgacgcagaagataaaatagctatcggacgcagcaattatccggaattggtatacggactaaacctgaatgccgaatggaaaggttttgatgtaaccttcttcttccagggggcagcgttggcagacttttactacaatggttacctggccttcccatacatagagggacgcggaggagctttgcttgaacatcacatcggtaacacctggacaccagagaatccgaaagcggaatttccacgcctgtattacggaggcaactccaataaccagttgttttcttctttctggatgcgtaatggttcatacctccgcctgaagaatgtagaaataggttacgacttcaagaaactgctactgtccaaggtatccgaaattcaaggattacgtctttacttcagcggttctaacctgctgacctggtcgcaaataaaatatttcgaccctgagttgcgctctactgacggaagtgcttatcctcaaatgaaaacctttgtgtttggtgctaacattacattctaaacttaaaaattgaaacgtgattatgaaaaagataaatacagccctgttctgcatatttgtattgctcttctgttcgtgcgatgtattgaacaaagctccactggacgaaatcgccgacgattctttctggtcggacgaaacactggtgaaatattacgtaaacgatctatatagtgaaatttccgtagacgggctgcaattacaggaaaaccgaagtgacaattctgtctcagcacaacgggataaatatcgtgcaagctggttcaaattcaactatgatatggtcagcgcttccgaccctcaggatgacgatgtatgggaagattattacgtaaaggtacgtaaatgcaaccgttttttcgaacgaatcggtacgtctaccatcgaagaaagcgagaagtcaagacttacgggagaagttcacttcttgcgtgccatgttctatttcgaaatggtaaagcgatatggcggtgtcattctactggataaagtactcaccatggaggataactgggaaattccccgttcgtccgagaaagaatgttatgacttcattctggacgacctcaaaaaggcaaccgaaatgttgccggcgtcttatggttcaagagaaaagggacgtgccaccaaaggtgctgcttatgcactgaaatcaagagtggaactgtatgacaaacgctacgaagacgtgatcaagagttgtgccgaagtatacaaactgggatatgaactggtagatggcactactccggaaaaataccgctctatctggtggactaccaacaaagataacaaagaaatcatcttcgacatccaatacaaaagcccggatgtctacaacaacatgatggtgtgcaacatggtgacgtatatcaacgataaatatggtgatcgcggatggggtggcctcggcccgacccaagaactggttgacgcatttgaaatggcagatggctcacctgccacgcaatactcacaggctcccgccgatcaggtattcgacatcaatacttgtggcatctatgaaggacgtgaaccaagattctatgctaacatcgttttccatggttcccagattttcttcaatgcagataaaggtgctgtaactgtagaccgctatctgatggatactcctgataaaggcgatggttcacttaccggatacaatgtttggaaatggatcgattatgataattataactatccgtacgcaggcgccagcagtccggacttcagtaccaactggatcatcctccgttacgcagagatttatctgaatgatgcagaagcgcgccttgagaccggtgatgtagaaggtgcccggaaagccgtcaatgtgattcgtcaacgagtaggcttacctgcgcttaccgaatccgatccggcaaaattgcgtgaactgattcggaaagagcgccgcatcgagtttgctttcgaggaacaacgtttctacgacgtacgccgctggaaagtcggtcccgaaacccaaacgaccctgcatggagtgcgctttgtctcaccgacggaatttaagataaccaaaacagacatccgtacctggaatgaccgtttgtacctgacaccgattcctcacgacgagattgtccgctccagcgtactgacacaaaacccgggatattaacgactgatttcatcacattttaaatatagcatgattatgaataaaataatttctatactgatttgctgctttgttgccggctgcctctttgtctcgtgtgaacaacccgacataccggacgtaccgaattatgacaaaacggaaatattgacttttaaagtgtataaccaggataaagaagagatcggtacccctgttattctttcggatgaaggtatcgtctccattaccgtagaaaacggcactgacctgtccaacgtctttgccacctgcacactctcttccggagccactctgtctccttcactcggaggctatcaggactggagtggactgagcaaagagtttactgtaatttcggccagtggtaaacgttcaaaaccatggaccgtgactttcaaaaccaaataaattcataatgaaatatgtaataatattcatcctctgcatctgctgctccctgcagatgcagggtaaacttcctgcctcaaaaggcgggaagtctaatctcgccctctgcctcgacgggaaagacaataacgtacggacaggtatgggaattctggaaccttcgtggaccttggagtcctggattaaaggtaacgactgtaaatgggacagtcttgaagttatcatcggaggaggtgaatacagtgaattgaactgggtggactatctgcctttggtcgtaaaagaaggcaaacttcactctacccgtgccaatctttcggcaccggaagcattggatgaccaatggcaccatgtggcactggcttgtgacggaaagcagaccatactttatcttgatgggaaacaagtggccaaagccgatacggtaatttccatccttcccggtgctatcggagttcacgatgtatattatactttcggcggattgattgatgaagtacgcatttggcgcaaagctttaccggaacaaacgatccgtcaatggatgaatcgccccgtagaagccagtcatcccgcttttaaatccttgtggggatattataacttcgacgacctgaaagaagaaacatccatcaattgggtaggtaaaggacatcaggcttaccacatccgcaatgggcgcaacaaatacaatggaaaagctccgctggcttatgcagtccctaacgataataccgcatttaaagagtatgacggaaaacaacagttattcaatgccgtagtcatccaaagtgaatgggatgttgatcaaggaagcaaagacgaccaggcactaaaactgagaatagccgtacaaggttcccggaaaccgctgaaactgacagagttgaaactcgatttcaccggcacgaccactcttgcagatattgagcaaatccatatttattctaccgggagtgaggcacgatccgtgcaacgcaaagaactgtttggcaacgggcatacccccgaacagtcaatgactctctgcccggagcagggagaagagatcctgttacaaccggggatcaactatttccttcttacattcgacgtcagaaaagaggcaactcccggacatacattatatgcctccgtaccttctttccgcctaaacggaaaacagtatattcccgaaacagctaccgaagaggtccgtaaacaagtgacttgcaacaaccaaacacattccaatatagtaaaagtgcttcaatggaacatctggcatggaggtattcatctgggtaacgaggggcagcagcgagtattcgacctgatccgaagcacccatgcagacgtggtcatgatgcaagaagcatatggcatccaacaaatgctggcagattcattagggtatcatctcaaaacccattctcttaaagacaacctggccatgtacagccgctttccgttggaacccatagcatggcgggaacccttcaaatcgaacccagccaaaataaccttaccaaacggtaagcggataatgcttgtagactgttggctccgttatgcctaccgcccggaatatacaagtggttacgctgagaaaggactggatccttctgtctgggtcgctgaagattccatattggcactgcccgatatccgcaatatctatacaaaggatattgtaccgaaccaggaaacagacatgccggtcattatcaccggtgacttcaactcatgtagccatcttgactggacagaacgagccaaaccattgcatcacggatacggtccggtggctttccccgcttcccgctatatgttggaaaatggtttcaaagatagtttccgtgagaagaatccggacgaagttgcatatcagggaggcactgttgccgccatctacgggcaaatgcaaatgtcccgtatcgatttcatctattataaaggagggctgaaagtattatcatccaaaatagtacgtacggctcccgagatagattatgtgtgggcatcagaccatgcagcggtacttaccgtctttgaggttgaataaaatgataggcacggatcgtgcagattccacagaatcaagagtatctgtttatctgccacatccgtgcctaaaatagatcaatactgtagagcaggctacaatataatgcgtttatagggttccttctgataatctttaatctttactttccgccaatcccagctgcttccattgcttggtgaaataactccggcatccggatatttattataaagatcgattgtttttactttctttggcaacttcgggaaaacgagtgtcaacaacacagaacgtccttcacagccttctacccacagtaatttattcatttcaatgccatgcgcctcttccagaatcggatattcatcacctgttctggaatcaacaagacacaatcccttacctatgaccaaccaatgacggtcaaaatgaataggtatattcaagacaaccaacgtcttctccggtaaagtttcaattttctgaattcgagaccttccgtcaccccggcgtgaagaaacggctaattgacttgcattaagagttacttcttccaatttatcggaacgcagtggacgcccctctctatcatactcagctattcgggcggcagtcggaaggaaatcgtcaactttcagattctccaacctccatgaactgccattgggaggtgtcaatcccctttcttccgggaaacaatcgcggatactaatcttttttacctttcggtcaagaggaggaaagaccagtgtaaactccagcatttgcttttcttgtcccacaacccaataagtctgatttagttcaattccgcgggtaagtgaacgaatcttataaacatctttcgtatcttcgtctactatggacaatcccttttcgaactgtaaccagtgccggtcataatatatcggtatagccaaagtaacgcgtgtatcttctttcgtccgttcaataaagcgtacatatatacttcgtttatacggtgcacgcgacaatacaacctgatctgcaggtaaatcgacgccaacagtataatcagcctcttttccgtgcagagaagtctgattcggtttctcttccgagagcgtatccagcattttcgatacaggagttgtaaccttagcaagtagttgactggatccggatttaactaaatgcgcctctcccgactgtatgtaatgaactatctttggggagtccaaaagcagaaaacacttttcatcacctacgctatccatctttttttcgttagatacgacttcgggagtttctgctttcatcgaaacagataccatcggcaatacaggttcaatcagaaccggcttttccgtaaaagaaaataaagccaatacacccgcacacaaaggaagcaacgctattttgcgcactccggcgaaacgttctttatattgatgtttcatcatgataaatcgttttttaattaatgaattatgaaaaccatttgcaaccttcgggctgtatcccatcaactcttcgaataagatgctttgatattcaaataattcaatctcaccggaaagcaaacaacggtccacttgaaattcatggagagcccgcagttcacgctttaccagccagacaaacggattaaaccaacataagatagataaaccttcaataaataaagtgtcccgataatgatgattacgaatatgtgccttttcatggagcagaactatacgcaacacttctccttctaacttccgattgataaagatcatccggtaaaacgagaatggtgaaacgacttcattgttacgcacgatacaaatcccatcagcctccatcgtacaacttccccaacgcttcaaacgccagatacgtgccatttcgaccaataaatgcatcaaaaggacaaatactcccaatccatatacgatccagactatttgccagtaatcccacgaagcataaaaaggttcttccgctatttcttcttccactcggggtacaattgcttcactaacctccgcctgcactgctgcgagcgtatccggttgtatcccatcattttctacttgtaccaatgaagtcttatccatttgtgtttcttgctttacaaccacccgttccatctttatcggccgcaccacctccaccggataaaccgggatgcgtaccaccgatacagctccggccagcagtaccgaaaaaagcaaataattccggcactggttaaacggggctttccgatcgaacaacaagtaatagcacagccataacacaaatgaagctcctatgaaacgaagaatagcccattcgctacaatcaatatcgatcataccttattcctttttgttttccttcaacatttcaatcagttcgtcgatctcctgtaccgacatcttttcttttttggtaaagaacgaaaccatcgccttcaccgaaccactgaaaaagttatctacgacccggttcataaaacgattcgtatagctctcttttgaaaccaacggataatactgataattctttccgaaactacgataagctacaaagcctttgttttgcaatacacgtagtacggtagaaactgtattatacgccggacgcggctcttccaaatcctgtaagatttcattcacaaaagcattttctttccgccaaagcacctgcatgatctggagttctgcttttgtcaattctttctgttcactcataccaagtaattttagattatacttctattcatcaagtatttgggatacaacctgaatggaatggcacaaatatataactataaatatagacacaaaactatatttatagtatttcacattaaaaagcaagtatttaacaataaatagatcattttatccacataatgagaaaaggccacctttaaacaaaggtgacctttccattttaatcgagcataaaacgcaattaccccatcatttcttcggcagctccttcaacaagcaatctaccgcagctttcaattgtgcatcttctcccttcaacgaagcagaaggttcattataaatcagcacatccggttcgagtgtctgattttccagatagttaccctgcatatccatgcagcctacctgcggaataccaaatacaagactcggatcaatctggcgttcccaccatacagctgtcatagttccggctacaggagtacctaccagtttaccgatacctaatgtcttatatacataaggagtaccatgcgcattactgtaattgtcttcacaaacaagcatacatgagggcttcagccacttattgaacggatcgctacctatatattgtccgcgaggaacaaaacgctgatattctttgccactaaggagagtcaccacatcgtcgtgcaaccaaccaccaccattgtggcgaacgtctacaactacggcttctttgttacggtaacgccccaacagttcggagtacatcttacggaaactctgactatccatgcccttgatatgtacatatcccaaacgcccgcctgataactcttctactttcttgcgattgcgctctacccatcgtttatatagcaattcgcgctgcgcaccgtaactgatcgccttcactgtctcttcaaaatgcttctttgtagcaggatcgtaaacagaaagcagcactttacgtcctacttttccttcaaataacgggaaataatcttctccttttttgattggagtaccatctactttttcaatgatacaacccggctttacatctgttttcttcaaagtgaaaggactctgctctatgatttcctttattttcaacccgtcaccggtataagtatcgtcataaaatactcccaatgaagctgtaggtaacgcccctcctacaccagagtaccgagctccggtatgtgaagcattcaactctccgagcatctcgctcagcagttcggcaaagtcataattattgttgatatgtggcaggaacttttcataagtcttcttatacaaaggccagtctactccctgcaaatccttcacatagaacttatcgtctacctgctgccaaacatgatcaaaaatgtaagcacgttcaccgcccggctgatagtcaaagaaagattcaaatgcgataggcgttgtcttgctaccggctatttcaattttcttcatacctccaccggtacacataaagatattctcacctttcttatcgggcaacagcgaaccgcctccgacacctttcaacagaatctttgttgaattctctttcaaatcgtgttcccacaaatcataaccgctttcaaacgctgccagataatagagcttatcacctttcggagtcaaaacagcatcacccatgaaagaagagttgacagtcagacgcacaatacgatcgaatcgattatcaagatcgaatttcagtggcttcacttcctccttcttttcttcctctccatccttcttacctttggcgtcttttttcttatcaccttttttatcttctttctttttcttctcagctttttctttctcagccttttccgctttctcggcttcttcaagcaaagcaaggtcttccttattcatgcggaaacgatcgtaagcatctacatcaaaaaacatgatgtaagcgtcatattgagcaccccagctgccatgactacggtatccggcacggtcactgaaccagaccattgctttgccacccagaacccatttcgcatttccgtctgagtaaccgctttcggtcagattatgcatttctcccttaccgtcagcgttcagcagcacaatatctttattgttccagccaccgataccaataaattcggaaagaatccatttactatccggactccactcaaaccactggtcaccatcactgtacgaatactgatactgggcatccattaccgtacgtaccttcttagttttgagattgatgacgcgaattgccgtacggttttcaaggaaagcaacttcttttccgtccgggctatacttcggattgaacgaagctatatccgaattggtcagacgttcttcttttaactctgtagcatacgtgaactgtttctcatctttccgcacgatacttgaagtatagagctgccagagtccgccacgttccgaagcatacaccaagctacgcccgtcgggtgcaaaatcgattccacgttcctggcaaggagtgttcgttatctgttttgtcgttttatattctaccgaagtcacatacacatctcctctcaaaatgaaagcaacctctttaccatcaggagatacagccatttcagtagccccactggtctttatctggcgaatcaaatctttatcatttctgtctgacagaattttcacagatactttctgcgacttaccaccgggagtcaacgtataaatctcaccatcaaaaccataacaaagattaccattggaagccatactgaggaaacgtaccggatgctgcgtgtgatgcgtcacctgcttggatgcattcgatcccggaatacgctggtagatattgaacgaaccattctcttcactcaaatagtagaacgactttccgtccggtgcccataccggttcacggtcttcaccgatgaaagtggtttgtttttcatagcgtggagtctgtccaggctgaagcatccatatatcacgggcaatcggtgacttctggtgcttacgccaataatcctcatatccttttttatcttgataaagaatagccccttccttattaatggagatgcattccatcggcatagatgaaaacatcacaggacgtcctcccgtaactggaatctgatatatctgctggaattgtccgttcgaaggaaaaccagcatcttcggcagaaggcatgatgtcggcagtaaataagagctgtcccgcatcactgaaagctaccggagtttcgctgcccgagaaagtggtcaggcggcgaggctcgcctccttctttcgacacaatgaatacatccagacttcccatacggtcggacgcaaatgcaatctgtttactatcgggactccaaatcggggttgtatcaaaagccggattggtagtgatctgtgtagctttgccaccggacaccggtactgtgaaaatatcacctttataggtgaaagcaatggtagttccatcgggagagatagcacaatgacgcatccacaacggaccctcttgtgcccaaagtgctccggcaaacaaaagagccgcagcactcatgaagagttttctcataatgtattatttaagtatattaaaaagcaaacctcacagcccttttgaaaagagttgtgaggtccgcatattctattttcagattaagaatccggcattcaaattagagagcaccaacttctttcagagctgcgttagttccgtgaacagcctttgcgcttgccgcaaattttgctttttcgtcagcagtcaattccagttcaacgattttctcgataccgttcttacccaagattacaggaacaccgatacaaagatcagattcaccgtattcaccttcaagcattactgagcaaggaatcatcttcttctggttgtggatgatagattctacgacataagctcctgctgcacccggtgcataccatgcagaagtgcccagcaacttagtcagagtagcaccacctaccatagtagaagcaactacttcgttcagcttttcttcgctcagcagtgtgctgaccggctgtcctttgtaagtggccagacgagccaacggaatcatagtagtgtcaccatgaccaccgatcaccataccttctacttcgtttgcattgcaacccaaagcctgagacaagaaatatttaaaacgtgagctatccaaagcaccgcccataccgataacacggtttttcggcaatccgagtgatttcaatgccagataagtcattgtatccatcgggttagagataactacgataatagcattcggagagtatttcaaaagattttctgctactgatttcacgataccggcatttaccccgatcagttcttcacgagtcatgcccggtttacgaggaataccagaagtgatcacaaccacgtcagagttagcagtctgagcataatcatttgtgcaaccaacgattgttgtgtcgaaacccaacaactgagcagtctgcatcatatccattgctttaccttctgaaacgccttcttttacgtccagcattactacttcgtctgccacttcattgaaggccagtacatttgcacatgtagcacctacgttacctgcgcctactacggttacttttgacataatacttatattttaataaagttgataattagttcgtatcgttttcgtgacggcaaaagtacaacgataatcgaaattaaagaaatttttccataataattttagttaaagaaaagtgaatagactgtgttactctgtattgaaatgattacttttgcagcgttttatcattcaaccttatagaatatgaataaaaagaatctgctgatcattgccgtatctgttctggtgctcgcgctcatcggtcttacttatctgttattctccgaaaaacagactaaccgtgaactggttcaggaattccaattggataaagaagatcttgaaaatgagtacactcgctttgcacagcaatatgacgaactgaaactgactgtatcgaacgactctttggcagacttgctggctcaggagcaggtcaagacgcaacgcctgcttgaagaactccgtacggtaaagagcagtaacgccacagagataagacgcctgaaaaaagaattggcaacactgagaaaagtaatgatcggttacatcaatcagattgactcgctgaataaactgaccgcccagcaaaaacaagtgatagcagaagtaacgcagaaatacaatgcggcttcacgccagatcaataatttgtctgaagaaaagaagaaccttaatcaaaaagttacattagctgctcagttggatgcaaccaatatctggattgaacctcgcaacaaacgtggcaaaaaagctaaaaaagtaaaggatatcgtaaaactggccatcggttttacgattgtcaaaaatatcactgccgaaaccggagaacggacactctacatccggataacgaaaccggataacgatgtattgaccaaaagcccgtcaaacacattcccttatgaaaaccgtacgttaggctactctatcaaaaagtacatcgaatacaatggggaagaacaaactattaacgtattctgggatgtggaagagtttctgtatgccggcgactatcgggtagacatctttgctgacggaacgatgattggatcgcagaagttcacattggactaaaactttaaaaccatatactttaaaagaggatgcgccagaatggttactaagtaaccggcttctggcacatcctcttttttattacttcaattctatcttattgaatgttttccatttcaataactcatgatagtggtgatacgattattttgttcccttccactatgaatctcgcaatttgcaaatcattcaaaacatttaatatttccccgacaggaagatgacgactggcagaaaaataaatccgttcctccagcaaagaatgggaacggaaaacaatatttgtgttataccatgccccaatttcctgcataacatatctcagagtgacattatcaaagataaatagaccttctgtccaactcttttgcatacagatatcagcctgagaaatacagatatcacctactctatccagataaacctgttcacccggctttatcttacagacttgtgtgctggctttatcactgacttgcaccgaaccttcatacaggacaactttagaagtagtaccacatccataagaatcaacatcaaataccgtacccaatacacgcgtctgtaaactcccggtctctacaataaagggatgtagagcatctctttgaacattaaatctcgcagcaccttccaacattacctgccgaagatcaccggtaaacactttcgggtattccaggcggctattggcgttcaacagcacttcagtactgtcgggcaaataaatggtaacagtggtagcgggtggtgttctgactgcaatgatccctttagcctctgtcatcatcaatttatcaggcgaatttacagaagcaaacacttcgacttcttgtgataaaaagttttcccgggacaaacccaaaaacaaaagtaatgccacggaagcaactgctgcaaagccgaataacaaagttcggactctcttctgccgtcggcgagaggcaaatgcctgccaagcgatttctgtctcttcgacagaaggcaggtcaccaagagcctctccgaaaagattttcgagcctacggggggctacatcgtttttattatcctctctctgttccatttgtttcctcctttccgttcatttcattacgtaaaatccgtaaagctttcgatatatgtttcttcaccgtatccggacttatttccaaccgttctgccacttgcctataggtcagtttctcccaataacaaagtctcaaaatggtacgcgtcggttcgggcaggctgcaagcaatagtttccgcttgccgtaactgtgcctcatgctgtcgatatccggtattcacatccatccgggtaacctcacgtaaagcatccaaatgctgttgttccacgcgcagatgctttaaccgattcaagcacgtattacgtgtagctgtatagaaataagcattctgcgtttctgcttccagtctatcaaaacatttccaagcctcttccatcacttcgccaacaatgtccttcgcttcttcccgatcgcccattaactgaatggcataacgcaccagacggggatatatctccacaaacaattgcctgaagcgttcttcccgtgaaacatgtccacgaaaccggaatatcgttaattttgccataagccgacaaaattagcaataattcttttatcaggcagattaaaggcgctgcttttcactctgtcccgcaccggtacctttatacttactcttggttgcattaaatttataagatatctgaatacccaaacgttgattatcattatatgaacgggtcagtatatgacttctgactccatatccatccatataatgataacgggtatgaaaaatatcatcggctgtaagtgttatcatcagagcatcttccagaaatgatttcgacagacgggcatttaccgtaccctctctgtggctcaaagaataactttgtttggctgctgtcgaaatattcccgttcacattcaaaaaccaaccatcaggaaaagtaaaactattgtcaagctcaaaataaaactgaggttcgttccaatgctgggttatccccaaagaacgaacatcggcatcataaaaatacatgcctccattcaattgcggctgccaacacccgattttaggagaaacattaaaattcattccataagtatctgtagtaggtatggaggccatggtaaacaacaacacccccggatgggtttcatcattataaggtttgaggaacctcgtatataaatccaatgtcctatcaaaaaagagatttacaaacgcccatctcgatccggcatccaatataaagacatggtgtttttgtggaaccagtaagggatctccgctacgatacatatatttacttgaatatgtaattgagcttgaaagcatgtgatagtcgggattattccttattaagcgataagaaagggatgcatgccagcctttatcctcatatcctactaaagcgacaggaactatatcattatacaccggactttgttcatcttgatgaaccccatattcataataatccgttttttgatgttcataacgcagccccacatcaaaattgaatttatccaagtgcagcgagtaatcggcaaacacagaataaatagactgtttgatatgatcatcggcgttgtcagaaaaaccactttgaacaaatatgtcgtgtctgttcgtaaacgtttcctccgtacccaacgacaatgtcccttttctgaaagagcgttttacaaccatacgcatagcatacaaatagtttcggacttcattttctgattgggcagctttatcatcgttgttgagaacttcatttgtggaattattctttcccaataaataatcagcattgaaatccacattccattgaccgaacgctccattatagtatccattcaccgaatgagtccaggtaggataagtatgtgcatactgcgaagaagatatttcttctgtcttttcaccatccttatacacaaaattgttgccaaggttagtctgattcacagaacctacattcgtacccggcatataacgagcacccaaagaattcttgtcatctaactcatagttgaaacctacctcaccggagaaataaacggctttacgaaaactggtagttcctcctcggacctcccatcgggaagaagcgtcagtttcctgatttaaaattgattcctggtaataatttccatgtttcaagtcacctttcacaaatagatccaatccacccgtacggtaattcaaatatagattctcactggcattatagtcatgtccctgagaaaaaacacctcgaaagccgccgcttatcccttgtcctcgctgacggatcgtacggatacgaatgactgaagatacatccgaaccatattccactcctggtgtagtaatcacttccgccgataaaatatcgtcagcacgcaaacgttccaattctccctgatcacgtaccttacggccattgatatagataacaggaactccatgtcccagaaccatgtattcccccacccctcccgttacaaaagggagatgggatatcatttccgcagcagagcccattttagctaaaggagtaccaacgacattagccaataaaccattatctttatgtactattaaaggatgatcgacactaataaccacttctttcattaattgggcatcggaaaacaaacatactttattcattgcaccgcaaggttggactttggtctgataacctatataagacgttttcaaaagataatctttcccttcttcacccggtatccggaacgaaccatcctgattcgtaaccactccgctcacaaatgtggaatcaattctattcagcagtagcacattggcgcaaaccaaggggttatgttcctcgtcattaaccgtaccttgaataattaccagacgtttgtctatccctgctttctgaatgacaaaatagttttctcgttctttatagatgaacggggtacttttcagaacgatggaaagtgcttccgattcgtttttttgatgaatagaggcagtaacatggtaagtctcagtctcgttataggaaaaaataatatgcttctcccctgctttctcaatcaatttcaaaacagcaggcagtggcttgtctctaagctccaacgtgatttgaccggcattctgagccgaaaaaggatatgcgcacaataataatatcacaaccatccagcctcttctgtcgtgtattccccaattcattgtttttctattttttaattagttgtttattatactacaaccaaagtatgcaatcgggtacgcaatattacgaaaaaaataaagtaagcgacaatcgtacataaattagaatattccaagatgtttcatagccttgacaatgttcctcaaaccggtttgtttcggagaatgttcaagtatcagtttcattgacagtacatgcattcctgccatccataacaggagacaatattccatgaaagtatgcaaagacatagcaaaaaaaggtaagagtacaatgggggctatatcggctttaaacttcatttattgtgtatgaaagaggagagattgtcaacgttgtgctgaccggggccaatgttgacgatcgaaacaaaaatgtaattgatacgctgacaaacaagatgtttggaaagctttataccgacaaggggtctctctctcaatcactttttgggaaactttttaatgatggcattcatatcgtcaccggtcttcgttcaaacatgaagcaacgcttgatttcgatttataacaaactaatgttacgtaaacggagtattatcgaatcacccaacgatacattgaaaaataaaaacaatttatacacattcaccaccgtagcgtacataattttccgatgaacttgctttctgtaatggaggcatattgttttttcaatgtcaagccggaggttaacttcgactttgacatagccccatcagacggacagcttaccatttggaattaagtcagtaagacaataaagattcgggcggtcaaagcatggtcgcccgaatctttattgtcttgtgattttgaggattaaaaggaaatcttaacccgagctcgcgttcaatagggagtttacgtaaaaaaactgtctttataataaatcaatattaaacctgcttcatatatattgaaagaatgataaaatattaacttctttttcatgtttcgagttgagtacggttttagtatgaattgtattatatgtaacatgaactattagtttttaatagattctaattaaaaacagactagtaattgtgataaaaaaatattataaataaaaaacagacatgaaaaaagtgaaaatcaatttatttttatttctttttttctctatcatcttagaagcatgctccgacgattatgcaacttacaacaatgaacccactaaaaatgtaacaacaagaaacgtcaaaagcaaagaacaatatatggagcgatttgctgaaatattatcaaaagccgttttcgaggaacaaagtgtcaggcactttttaaaagaggaagctttaaagaaaatagataacggatataatattttttatcccattgccagagatgggcaaataaacaattgttctttccgagatatattaataaagtacgccaaagataaagaggaaatagagaacatcgagacaaatgtacctttactaaatatccacataccagaatacgggaatcttttaataaaagacatggatgatggagactttgaagtaccggttctattagataggacattatactataatggagtcatagtagatacaattgctgctaatgaaatacctggatttaatttgtttgtagtttgtgaaagtgccagtataagaaaaaaacatatacaaactcgaaatctttcagcttaccctttaaatgaaaattatgaatttgttgatcagtcttttgatcctacatactccgagaggactgcaggagtaacacgtgcttcggcatatgaagagcttagtgaaaaatataaagatgaaggctatgtcccaataaaagatatagatccattgttggtggcagcctataataaatcctcccaaaagcccagggcgacgagatcacttatgtactatggcttaaatagtataagcgaaactcccaaagaaattcgtccagatatcaaagattgtatttttagatttaagattgcagcagatgcgttttctcgcttggaggatatagcaacagggcaaaacaagccattattctatgataaagtacagcagaaaaaaggctctttaagcagagaagaagttttaggacgtatcttaacgggaagagctttctgttttcttttcaggatcgaaggaagtgtaaacggaaacaacgtaatatctgaaggaatgaagatttatgttacccctgaaaaattattcaatcttaaaatcaatgaacatagaagacataaaacgatgtttagacgtacaaagtatacctatacaattgatagaaatggtattaagtccaaatggttctatcctttagattacggacacgatacaagattgaatgaatggaacatagctaaagatcccattaacaaaaaggttgtagtatatcttattaacccggatgaaggaacaaccgcaaaaatcacagaaacatattctttaacttatatatccaataaaggaatagatggaagcatttctgctccaatcattaaaggaatcaccctaggaataaatggaaaattagataatacaacgacaactcaaaagacagtaacaacagaatattctatcacccaaagtaatgaacgtattgacgagttctactttgatttttttaatgactatcccattgaatctgttttatccaataacgagtacgtaattcctattagaaaaggtaaaggaataatagaaacaagtattttaccaatatcaaatagtttctttacatttaaacgatttaaaagatgaaaaaacaagtaactttctttatctgcacaattattttgttgactttgtcgtcttgtcataaggaagcagattattctttaaataattcaatctggatacatcaatttcaagctgaagaacgggtagaaggtggtgtaaaagcagtaggacttttcttcggagcaaaaacaattgaaaagtatagccttgataaagactacaaagcattaaaacttttgaacacatttaactatgtaaaggaaggtaatgaaattataatcaatggtgcattcagacaaacagtggaagataattatcttacttttggtgatggaatgtactatcgttcagaaaaaagcaagggctcttttttccaaaagtaataaagaaggagggagcaattaagaataggtattgaaggagcagagaataaataattcctctgctcctttttattaaatattcgtgctactgccacttttgatccgaaccatatcagtaaatcgggtaaataccccctattgggttgctcccggcccagttatgcgaagatgctcaaaacgcaatctggaaatctccagatataagaataaaaaggttattgtctactattgccacgaaactttcctttctgcttctctgttcgtgttattgaaaaacagaaaccttaaataaggtttttgaaccagtaagctaaataccaattcgcaatagttgtttattatactacagccaaagtatgcaatcggatacacaatatcacgaaaaaaatgattcgggaagacaggatcaatccatagttgataaataagcaagtatacaggctttcagcctgctaagtcttattggatagaaaaagacacgatgatacttaaacagatgaaagacaagacattcaaagcactaaactcttgctgggaaaagacttgctttaacacagtgttaaagcttgctctttagattcaaataacaagtcatttaaatgcaaaaggcttgttatttgcatttggaaaagaagaagccccagaatgcgattaacaatgttaattgaaaaagcgagaatacatcgcccggtattcaaacatcaggcctaaataacaaaaaaaattaaatcgttttgctttttaagattaaccctttatatttgcatcgttgtttatgcaattattgtttcttgtcctaacaaggataacaagaacaaaaccggataaacaaacaacccgcaagcattgttctttaaaatgaagtattacctttataatgtataagatgcgatgaaaaaaatcctgtttctgttttttctcctgacaactactttctctctgaaatcacagggaatcctatccttagatagttgccgtgcattggccattgccaacaacaaagagttgttgataagcggagagaaaataaatgctgcacactatcaaaacaaagcagcttttacgaactacttacccaacttctctgctacaggggcctatatgcgtaaccaaaaagaattctcgctgctcaacagtgatcagaaagctgccctatcgggcttaggaaacagcataagcggaccactgcagcaggctgcacaagtcatcggacagctccatcctgaactggccccggctttgtcgcaactgggaggggctatcgtaccggccttgaacgaagccggaagttctattgtagacgcattccgtaccgatacccgcaatgtatatgcaggagtcatcaccctgacacagccattatacatgggcggcaaaatccgggcatacaacaaaatcactaaatacgctgaagagttggctcgccaacagcacaattcgggtatgcaagaggtgattctcagcacggatcaggcctattggcaggttatctcgttggtcaacaagaaaaaactcgcggaaagctacctgaagctattacagaaactggacagtgatgtagaaaagatgattgccgaaggggtagccactaaagcggacggactctcggttcgggtgaaggtaaacgaagccgaaatgacactgacaaaggttgaagacggactcagcctttcgcggatgctactgtgccaactgtgcggcatcgacctgagtacccccgtcgtattggccgacgaagacatcgacgacattccgttaatgcctgttactaccgactttgaggttgaaacagcctatgccaaccggcctgaaatacggagcctggaactggcaaccaaaatttatcaacaaaaaataaacgtaacccgctccgagcatcttccgtctttagcactgatgggaaactatatggttactaacccttccgtattcaacagctttgaaaataaattcaaaggaatgtggaatgtaggcatcatgcttcaattacccatctggcactggggagagggcctctataaagtaaaggcagccaaagcagaagcacgcatcgcccagtatcaactggaagatgccaaagaaaaaatagagttgcaggtcaaccaatcggccttcaaagtgaacgaggcagcaaagaaactgaccatggcgaaaaagaaccttgagaaagctgacgaaaacctgcgctacgccacccttggattcgaagaaggagtaattgctccaagcaacgtacttgaagcccatactgcctggttgtcggcccaatcggaaaagatcgatgcacagattgatgtgaagttaacagagatctacctgcagaagtcattgggaacactgaaataaaatgaataagtaaatttagagaaagccaatctcaatcgtaaatcgtaaaatcgtaaataagatgacatcacaaaaatcacagaacagcaatatgctgcttgcattcctcactctgctgggagttattgtactggttgcagttgtcggtttcttcatgctccgcaaaggtccggaaattattcagggacaggccgaggtgaccgaataccgcgtttcgagcaaagttcccggacgcattctggaattccgtgtgaaagagggacaaacagtacaagcgggagacactctcgccatactggaagctccggacgtaatggcaaaaatggaacaggcacgtgcagctgaagccgctgctcaggcacaaaacgaaaaagcaatcaaaggggcacgtcaggaacagatccaggcagcttatgaaatgtggcaaaaggcgatagccggtgtcgatatagcagagaaatcatacaagcgtgttaaaaatctgttcgaccagggagtcatgcctgcgcaaaagctggacgaagtcactgcgcaacgtaatgcagccatcgccacagaaaaagcagcaaaggcccaatataccatggctaagaacggtgccgaacgtgaggacaaaatggctgccgccgctttggtagaccgtgccaaaggagctgttgccgaagtggaatcgtacatcaaagagacttatttgattgctcagacagccggagaggtttctgagatatttcccaaagtgggcgagttggtaggcacaggtgcaccgattatgaacattgcagtgatggatgacatgtgggtgacattcaatgtgcgcgaggatttattgaagaacctgacaatgggatctgaatttgacgctatcgtgcccgcactggacaacaaaacgattcgcctgaaagtatactacatgaaggatctgggtacttacgctgcctggaaagcaactaaaactacaggacagttcgatctgaaaactttcgaagtaaaagctactccggttgaaaaagtagacaatctgcgtccgggaatgtcagtcatccttaaaaaatgaaagaaagagaaaagaaatatatagccctctggctggtcatgaagcgcgaatgtcgccgtcttgtgtcccgtccgctctatctcttctgcatggtgatagccccgttattctgctatattttcttcaccacgctgatggactcgggactgcccaccgacatgcctgtcggcgctgtcgatctggacaactcaaccagttcgagaaatatcctccgcaatttggatgccttcgggcaaacggctatcgtggcccgttatggaagtgtgaatgaagcccgcactgcaatgcaggaaggcaaaatttatgggttcttctatattcccaaagggttgtcggccgatgctcaaagccaacgacaacccaaaatatctttctataccaacaactcgtacctgattgccggctcactgcttttcaaagacatgaagatgatgtccgagcttgcatcaggggcagtcagccgttcggtactgtacgctaaaggtgcaacagaggaccaagccatgggatacctccaaccaatagtcatcgatacacacccgatacagaatccatggttgaactactcggtctacttgtgcaacacccttgtaccgggagtacttatgctgatgatattcatggtaacggtattctccatcggcgtggaaatcaaagaccgtaccgcacgtgagtggttgcgtctgagcaataactccatttatatcgcattggcaggtaaacttcttccacaaacggtagtgttcttcatcatgggtatattttataatgtatacctgtacggattcctgcatttcccatgcaacagtggcatcctccctatgctgctggccactttgtgccttgtactggcttcacaatgttgtggcatcgtgatgataggcactttgcctacactccgcctcggattgagttttgcatcattatggggagtcatctctttctccatatcggggttctctttcccggtaatggctatgaatccggtattgcaggcattgagcaacctgttcccactacggcattactttctcatttacgtagaccaggcactcaacggatacagtatggcttattcctggtccaattatatggcgttattgatttttatgttacttcctttcttcgtggttcaccggttgaaggaagctttgatatactataaatacatgccctaatgaaagatataaaattaaaagataaaatagcacaaggagtcaacgacctgttttatatctggaaacgggagtttggaaccaccttccgtgaccagggagtattgattttcttcgtactcgtgccattggtatatccgttgatttatagcttcatctataccaacgaagtggtgcgcgaagtgcccgcagtggtagtagacgattcacgctcttcactcagccgcgaatatctgcgcaaagtggacgccactcccgatatagaaatcgtagcgtattgtgccgatatggaagaagccaaacaaatgctgaaagaccgtctggcttatggcatcatttatattccgaaagaatttagtgataacatagcacaaggtaaacagactcaggtaagtatttattgtgatatgagcggactgctatattacaaaagtatgcttctggctaacacagccgtatctttagacatgaacgaagatatcaaaataacccgttcgggcaataccaccgaccgccaggatgagatcacagcctaccccatcgaatatgaagacgtggcaatgttcaatccgactaacggttttgccgcttttctgataccggcagtactaatcctgattattcagcagactttactgttgggtatcggactttctgccggcaccgcccgcgaaaacaaccgcttcaaagatctggtgcccatcaaccggcattacaacggcacgctgcgtattgtaatgggtaaaggactaagctatttcatggtctattcgctcgtatctgtttacgtactttgtgcggttccccgcatgttcagcctcaaccagatcggacaaccgggtacattagcgttatttatccttccctatctgatggcttgcatcttctttgccatgactgcgtccattgccatccgtaaccgggaaacgtgcatgctgatattcgtcttcacgtctgttccgttactgtttatttcgggaatctcctggccgggagcagccataccgccgttctggaaatatttctcttatatattcccgtctactttcggcattaacggatttgtgcggatcaataacatgggggcgacactgagtgagatcccatttgaatataaagcattatggatacaaacgggattctacttcctgactacctgttgggtatatcgctggcagatcatcaagagccgtaagcatgtcattgataaatacaaagaaatgaaaggcaaaggaaaacctattctttcataatcacatacacatatttattccggatttatccggaaatacctgctattgcaattcaacccgaaaatatatcggacagctattgtctgaaacaaagataattagtacattcgaggcgtttatattttcaagtggaagatgtaaacacaacacatacaataataaaacacatgttatgaaaagaaaaatgatgtcccttttgctcgcattggcagtaataagcggaaatagcgtgtacgctaaagtgattgacataatgtctcccaacggagccattaaagtatcggtagatatcaaggaccgaatctactattcagtgtcttatgataacaaccaactattaaaggattgttatctcaacctccaactgcaaaatgaaacactgggggacaatcccaggctgcggagcacgaaacgtggaaccattgacgaaagtgtgaaacgtgagataccttttaaaaatgctattgtaaagaaccaatgtaacacgctgaggatgaacttcagcggaaactatgccgttgagttccgggtattcgataacggtatggcttaccgttttgttacagacaaaaaagaggataacattgtaatgggagaagatttcgcaattaattttcctgccaactacaaagcccacttatcacaaccggatggttttaaaacctcttacgaatatccatatactcatatagatacggaaaactatgctgccaccgatcgtatgagttacctgcccgtactgatagaaacggacaaagcatataaaatcctgatatccgaagctgacctattcgattatccttgtatgttcctcaaaggcaccggcaagaatgggatgcaatctcttttcccaaaagcacctttggcatttggcgaagatggtgaccgtagcctcaagatcactaaagaagctgattatattgccaaaacaaccggaaagcgttcattcccctggcgaatgatggtaatctcaaaagaagacaaagagattattgaaaacgaaatggtatataacctttccactccttgtgtccttgaagactacagttggatcaaaccggggcaggtgagctgggagtggtggcacgatgcacgtctctatggggtagatttccgttccggctacaacatggattcgtataaatactacattgactttgcttccagattcggcatcccctacatcatcatggatgaaggctgggccaaaaacacacgtgatccgtttactcccaattctactatcaacctccctgagttaattcagtacggaaaagaacgaaacgtgaaaatcgtactctggctaccatggcttaccgtcgagaatcacttcgatctctttaagacttttgccgactggggcatcgcgggagtaaagatagactttatggaccgcagcgatcagtggatggtaaactactacgaacgtgtagcccaagaagcagctaaacataaactatttgtggatttccatggtgccttcaagcctgcgggactggaacggaaatatccgaacgtactctcttacgaaggtgtattgggcatggaacaaggtggcaactgcaaacccgaaaacagtatctatttaccctttatgcgtaatgctgtgggtccgatggacttcactccgggatcaatgatttccgctcagccggaagacaaccgttctacccgcgccaacgccatgggctcaggaacacgtgctttccaaatggctcttttcatcatcttcgaaagtggtctgcaaatgttagccgacaacccggtttactattacagggaacttccctgtaccgaatttatcgcaagtgttcccgtcacctgggatgaaaccaaggtcctttatgctaaagtaggtgaagcagtcgtcgtagccaaacgaaaaggagaacagtggttcatcggagctatcaccggcaatcaaccacaaaacatcgagatcgaccttggattccttccggcaggacaatcattcacattaacctcatttgaagatggcattaacgctgaccgtcaagcaatggattacaagaaaaaggagtctaccgtgaacaatcaaacccgcatgacattgaaaatggtacgcaacgggggatgggccggaacaattaaaatgaaatagaatataaatcaagttcaccacagaacacacagagtcttcatctcttgctaatggaatatttatgaaaaaagtttctctgtgggactctgtgtcactctgtagtgatatagcatattacaaaaatgaaaaaacaaataatacaccgctggatgctgatggctgtcttctgcctcggagcatcatttataggaatcaatgcccaagaaaaagactgggccagcctgcaacgctatgcgcagcaaaatgccgaactccccaagccggagaaaaatgaaaagagagtagtcttcatgggcaattccatcacggaaggatgggttaacacacatcctgatttcttcaaaaacaacggttatatcggccggggcatcggtggacagacttcttaccagttcctggtacgtttcagagaagatgtgatcaatttatcccccgcattagtagtgatcaatgccgccaccaacgacattgccgagaatacaggaacgtaccatgaagaccggacttttggcaatatcgtttcgatggtggaactggcaaaagccaaccatataaaagtgatattgactaccactttaccggctgctggctttggctggaatccgtccatcaaagatgcaccacaaaagatagcctcactcaatgcacgcctgaaagcatacgccaaagcaaacaagattccgtttgtagactattattcatcgatggtaagcggtaataacaaagctctgaatccggtctatactaaagatggagtacaccctaattctgaagggtacgacgtgatggaaaagctcatccagcaagccataaacaaaacgatacgctaaccattgaaattaaaatcatgaagtcatttgtctccttctgccttttattgagtatttgcataagtaaactatatgcgcaagacattaacatagtatacatagtttacatcatttaacacacttcgctttgtttagttacgaccgtttcgtagctttgtgatataaacgtaattaaacatactccatggaaaagttgacaatgcaagaagaagaagtgatgatttacatctgggaactggaaagttgctacgtgaaagacatcgttgccaaatttgagcaacccgtacctccttacactacggtggcctccatcgtgaagaatctcgaacggaaaaaatatgtaaaggcacagcgcgtaggaaatacgtacctgtacactccggctattaaagaaagcgaatataaacgaagtttcatgagtggagtcgtaaggaactactttgagaactcttacaaagaaatggtttctttcttcgcaaaagaccagaagatatcgaccaacgacctgaaagaaatcatcgacatgatcgagaaaggaaaagaaaactaatcgctaataccctgaaaaacatgactcccgaactggcatacttcctgaagataaatatagcaattgctttattctacgccttctatcggttgtttttctacaaagacaccttttttcagtggcgacggactgtattgctttgcttctttgtcatttctccactctacccggtgttgaatattcaggagtggatcagatcgcacgaacctatggtagcaatggccgatttatacgcaaccattgtattgcccgaaattgaaataactcctgaagttgcgactacggattggcaaaacattattttatctacagtaaatatcatctattgggcaggagtcgtattacttttaatacgcttcgttgcccagtttgccagtattttgcggttgcgttttcattgtcagaaagatcagatagaaggaattcctgtctatttgcttgacaaagaaagtggtccgttctcttttttccattggatcttcattcatccgcaagcacatccgcacaatgagttaagcgaaatccttactcacgaaggaacgcatgcccgacaaaagcactccatagatgttatcatcagcgaactgatgtgtatcgcctgttggttcaacccgtttgcatggttgatgaaacgggaagtacggaacaacctggagtacatggccgacaaccgtgtactggaagccgggcatgattcaaaatcttatcagtatcacttattgggattggcccatcaaaaaagtacaatcactctctccaacagtttcaatgtgttgccactgaagaatcgcatcacaatgatgaataaaaaaagaaccaaagagataggacggaccaaatatctgttatttctcccgctggctcttgccctaatgatagtaagcaacattgaagccgtggcacgtactactaaaaacatcgcaaaagaaatgatgcaaacagtggaagagcagattgaacagaaagttccggctgaagaaaataccccatcccatacggcagatgctccgcaacctcaaacggacaatacagccggacaaacaacctcccaaaaaccaaaagaacaaactgtctttgaagtagttgagcaaatgccggaatttccgggaggagtgacagaaatgaaaaggttcatcagcagtcacctccgctaccccgctatcgctcaggaaaacggaatacatgggcaagtcgttacccaattcataatccgggcagacggaacgattaccgactgtacagtagcaaaaagtgtacatccaatactggacgccgaagcattacgtgtaataaaagaaatgcctaagtggcgtcccggaagacaaagaggaatagctgtagccaccagaatgaccgtcccggtacggtttcacctgatagatgaggcgcccgatccggcaagtacttccgataagaatcttgaaaataaaatttttgatgtagttgaacaggctacggaattccccggtggaatgaaagcttgtttagcatatatgtacaaaaatataaaatatcctacagctgcacaggaagcgggcatacaagggcaggttgtcatacagatgattgttgataaagacgggcatataagagaccccaaaatagtgcggggagtatcgccggaactgaatgccgaggcactccgcatagtaagcggtatgcccaaatggatacccgggaaacaaaaaggcaagaacgtagcgacccgattcacactccccatccggttccgtctgacctaaccgtactcccaacctgaaaatcactttaataaaaatagtatgagaaaaatcacatttattgccattctcttgttgtgcatctgcaaccttgcaaaggccaaagaaaaagtcatagaacagccgccattcatagcttggagcagtacctcgattcaagtagaaaaagtcgtcctcagcgacacggctacagtactttatatcaaagcattctatcaacccaaacaatggatccggatttccggacaaagtttcctgaaagacaataacggggaaacctacgttttacgttcggggatcggtattaaacccgacacggaattctggatgcccgaatccggtgaagcagaattccgtttagtttttccgccaataccggcctcagccacttctatcgatttctccgaaggggacaatgttcaaggggcattcaagatatggggcattcaacttaaaggaaaagctctccccgaacttttgttaccccaagaagccattgtgcagaaagtagatataaataatacattgcccgaaccgaaattcgaatacaaagaagccactttcaaaggaaagattctggattatcgcccggggctcatctccaaaatagcaccgattgtatttgacccggtaaaaggtgcctacgaaggagcggaagtaaaaataaacaatgacggcacatttgccactcaaataaaagtacctgccactacttcggtcgccctccgtattttcggtaaaatgatttcttcctacgtggtaccgggcgaagagagcagtatcattatcaatacccgcgaactatgccggcaacaatccaagttccataaggacgacaaaccttatggcgaagctgtttactttggcggcgcattagccgggctgtcacaggaatcttttaaatgtaacctaaatccttccgttatggataattaccgtcaactattccgtgacatagcaggaatggacgcccaagcctataaagactttatttatggcaaacgggctactattcttgaatccatacagaaagcctcaatcagtcaagcgctcaaaacggtattaatcaatcaggtagacgccggtactgcccaggctatctctttaacggaaatggccatcaagcaggcttatgccatggagcataaaatgaaaaacgaagaagtcagggaatactttaaaacgactcaaataaaactacctgaaaactattacgcggatgctttcagaccacttggctccctcaacaccatggcattactttacaatccccggttgaccgaactggttccgtattacctgcgtcattggagagatgaactggttaaagcatggggaaccgataaaggagtttatttcgatattaataaagcaaacgaactctattcatctatcaaagactttacccccctgaccgccgaacaggaagtcctgcttgccactcttccatccgcttgccaaaatgaactgcgggagggcaatgaacaacttctgaaaaccattgaagccaataaaaagaaaaccggatatactattcatgaagtaggggaagtcagtgatgaaaacctgtttacatccattatctctaaattccggggtaaagtaatcctggccgatttctgggcaacctggtgtggcccgtgtcgcatggccaataaagcaatgctgccgctaaaggaagagttgaaaggaaaggatatcgtttacctttacattaccggcgaaacttcacccctgaaaacatgggagaacatgattccggatatccatggtgagcatttccgtttaacggatgcccaatggagtttcttaggtgataaattcgacataagaggcgtacccacctatctcatcatcgatcgggaaggaaatgtcaaacaccaaaagacaggattcccgggtgtagcccaaataaaagaggaattgatgaaagtatatgattaaccctccggacaacaaacaataaacaaagaacgatcggctcctgcctatgggacaaggaaccgatcgttcatcatttaaaagcgcttatcgttacttatgtaactctacaatctttgtgggagccatttccacattccgtttgtccacctgtcgtactacactggcagccaacgaaagaaatgcacggccggtaaccgtattctcatccaaagcaacaggggtaccgttatcgccgccctcgcagatactctgtacaatcggaatctgtcccaacaacggaacattcatctcttcagccagcttcttggcaccttctttcccgaaaagataatacttgttctccggaagttctgccggagtgaaccaagccatattttccaccagaccaagaataggaacattcaccttatcattagtgaacatgttgatccctttacgtgcatcggccaaagccacagcctgcggagtactaacaacaacggcaccggtcaaggccaatgtctgaactacggtcaggtgaatgtcacttgttcccggtggcagatcgatcaggaaatagtccagatctccccaggcagcatctccgatcaactgcttcagcgcattgctcgccatccccccacgccataaagtagcttggtcaggatcgacaaagaaaccgatagaaagtaattttacaccatacttctcaacaggaataatcatatcgcgtccgtctattttttcagcgtacggacgggcatcttctacctgaaacattttcggcatggaaggaccgaaaacgtcggcatccagtaaaccgactttataacccaacttagccaacgctacagccagattggccgacacggtagatttgcccacccctcctttaccggaagagatacctatgatattctttacccggggtaacaatttaccgacttcgggacgtgcagcctgtactgttttcacactgatatttcctgctatctccacgtctttgctcacatgggtaagaatagctgtttcagcagcctttatcaccgacttcataaacggatcggtcggtttttcaaaaatcagggagaatgaaaccttcattccctctatacgaatgttatcctccaccataccggcctccacaagattctttccggttccgggataacgcactgtagccagtgcatcgagtatcaatttaggatagattgtcatagtttgtattatttagatgtctgcaatccgctccgcttgctacggttatagctccggtacgaatcgagttcaatttcaatatccggttctctcaattctccttcctgcggtaacaggaatttgatgtatttaatgcttaaaccacgatcgagccattgttgttcataataggtcttgatgcccagaatgtcatcaacgagatcggagtgataaagatcttcggtgataaactccaccggcagtttgttctcctcaatcatatatttggtataggtgaacataaagttactgtctgtcttcagatggataataccgttggacaccaaaaacttacgataacgttccataaaataggtagaagtcaggcgtttggtcgctttcttcatttgcggatcagagaaagtcagccagatctcactcacttcgccttccgcaaaaaaacggtcgatgatctcaatgttggtacgcagaaaagcaacattcttcatgcctgcctgaagagattcggtggctcccgtccacatgcgggctcccttaatgtctaccgcaataaaattcttatcagggaacatccgtcccagtccgacggtatattcgccgcgcccgcaacccaactcaagtacaatcgggttatcgttcttaaaaaactctttgtgccattttcccttcatgtcaaaaggcacattgtccactgccgagtaaggatactcaaaaacatgcggataacttgccatatcggcaaacttctctaatttattttttcccattcaaaaaagttaaatcgtttctacccagccggtatagttataaaacacccggtcgttaaattgctggcggaacaacgcatatttgtcaatgcccgtacaatggcagactcccagacgtttgggaagcttcatgcccagaaaagcggaaatcacattgaacttttctatgcctgcgttatggatatgaaagcctcccatcaccagtttcagtcccaatcccggaaatgcagtctgcacggcacgaataatattggtaatcccccggtgcgaacaggcactcagcactgaaagggatttttcactcttcaatatcaatgccagttcatcttcaaaggtatcgggacgcatctcgcctcctatctccacgaagaaatgctcaaagtgcgtgtcgttcctgtctactatcctgacatccgcaaacgcaaatacacccggtacaatctccgtagtttcgtcgatcagccaaaagcgggacttatccaatgcttcgggatgcaacattccgttttcacgttcattcttgaacttcctgcggaacacttcttgtttacataccacctttgccctgctgttcattttcaggaaagtatgcaatccacctgtatggtcacgatgtccgtgggacagtattacaaattccacatcggtcagatcgactcccatcaaacgggcattccggataaacaaatccgaagcaccggtatcaaacagcaccttgtgttcccccgcttcaacaagcagggaaagcccatgctctccctgtaatcccttaccgtaaacactgttttctgcgagggttgttattttgtagttcatttatcgaacgtttattctacaatggtcacccatccgtgagtgtcgggctcgtcaccgtactggataccacgcagcttgttgtagagtttctcacaaacaggacccggctttccgtctttcgaaattacgtatgatttaccattctcaaggtcatcgatacgttcgatcggactgatgacagcagcagtaccgcaagctcctgcttcttcgaaagtgctcagttcttcttcgggtaccggacgccgttctactttcatgcccatatcttctgccaactgcatcaggctcttattggtgatggaaggaaggatagaagtagacttcggtgtgatgtatgtattgtctttaataccaaagaagttggctgctccgcattcatcaatgtatttcttttctttggcatccaggtagaactcacaggagtagcccagatcgtgcgctttcttgttggcacgcaggctggctgcatagttaccaccaactttgtagataccggttccgtgaggagcggcacggtcgtactcgcggataatgacataaggattggtagaaaaaccacctttgaaataagggcctaccggtgtgacaaacacgacaaacatgtattcatctgccggatgaacccctacctgggcactggttccgataagcaacgggcgaatgtacaaggacgccccactctcataaggcgggatgaagcgttcgtttaatttcactactttcagaatagcttccttaaaacgttcggtcggcaattctgccatcatgatgccctgacaggtggattgcagacgtgcggcattctcttccagacggaaaatacgtaccttaccgtctttaccacggaaagctttcaagccctcgaaagcctcctggccatagtgaagacaagtggcagccatatgcagattcagcacttcgctgctgcttatctcaagttcgccccatttgccgttacggaaattgattctcacattgtaatctgtcttcatatagccgaatgacagattggcccagtctatctctttcatatcgttagttattagttattttcgattgagcaacaaaaataacctttattcttcagatagcctcctttcttgcagtaatttttcaatttcccgatccgcctttgtcagctttccggcgcagaaagctattatttcattggcttcttttattttttcactcagttcgtcaatctccagttcgttactgtcaatctggcgaacgatcttttccagacgttccatggcctgtgaataggtttcttttttctttgctggcatatttatcattataaaggaatactttctactttcgatttcacttcaccttcgtaaagacgggtaatcaactcgtctcccggtcgcagacaggcagcattcttcaccgccttcccctctttcagcgttatgctgtatccccgtttcagtagtttttgtggtgaagcatccgcaatgcggttttgtaaaagttccaaccgatgatgctgacgggccaataaggtctcagcagcatgagagaggttgctctttgccatttgcaactttatccgcgattccgaaagcttgcgcatcacttgtgaaggaatgcgcgactgtaacagtgaaagtctctttcgctcttgctccagacggtgatagatgcgggcatgcaattctccggccaactcttcaagccgatccgcggcctcttccatccggttgattaacaattcggccgcagctgtcggagttttcacccgggtatgtgctacggaatcgagcacggtatcgtcccgttcgtgcccgattccggttataacaggcagtggaaactgggcacaggcagcggccagcaggtaggtgtcgaatccggaaaggtcggaagttgcccctcctccacgaataatgacaactacgtcgaactcttccatccgggcatttactgcatcgagagcggccaatacggactcttccacctgattgccctgcatcagagcggggaaaagttccgtattgaagtaaaatccacgggagttgtgctgcaattgatggcagaagtcaccataccccgcagccgtagccgaagagatgaccgcaatgcgttgcggcagcaaaggcatttccagttctttgttcagcgtcaacactccttcttctgcaagttgcctgagtatttcccggcgccggcgtgccatatcccccaatgtataggtaggatcgatgtcctgcacagtcagactgtaaccgtacaattcatggaaagcaacggtcactttaaccagcaccttaatgccggaagtaaacgactgcccggtggcttcttcgaaatagggcttcagcagccggtagatattggcccagatcgttcccctcgctttggctatcagattattgctgcggggatctttctggacaaactccagatagcaatgtcccgtgctgtttgtacggacatcgctcaactccgcctgtacccagtattcatcgggcaggcactgttccaggctccgccggaccaaagcattcagttcgtgaagagaaagggtgtcttgcatactttattttttcttagaagcagattgataggccttccacagatcgggcactccgtatccatagatgttatcggggaaatccacccggtcgccggattgacgcaccagttcgatgatttccttagcagtcagttgcggacaagcttgccacaggcaagccaccatgccgcacaggatcggtgaagcaaacgaagttccgctcgctttgcgcaaattaccgtttgtccccatcacatccgagttcagtcccacggcaaccacatcgggtttcacgcgattatcggctgtgttgccgatagaagaaaacgaagccaacacacctctacggtcgatagcacctaccgtcagcacattctccgcatcacccggtgccgtgatcttcttccaagaggaggcgcccgagttaccggcactgcataccagtacgattcctttatctgccattttcgatgcctggcgggacatcagtgcatggtgcccgtccaggtcacgatatttatagttcttggtagaatcatcgaaagtgaaatatcccagcgaagtattcaccacatccactcccacactatcggcaaactctacggccgccgcccaatagtcttgctctaccaggtgttcggacgcttcatcttcactgcgaagcagccagtaggaagcttcgggagccgtacccaccatcacgtaaggttcgttcattgccatacaagacaaaacagccatcccatgcgagcctttggcatagatatcgcttcccggttcgacaaagtcctttgtacccaggatacggatattcttcatcgcatcaatcttgtctacgttatggtatccggcatcgatcacggcgatggtcatgccttgccccttgaatccggcttcatgcagtttctcgccattgctggtctctatttgccggaaagcgggaccataataggcttcgctcctggccggactgttcaccagagagtcgcgtttatcttccgcagcaggtttcgacggggcaacccacaccttctccgtggcgcgcacaaaaggcagcgcagctatttcgcttatcacagtactgtcgttgcaagatacggtgacgaaattatcccattttccggtgactacgattttcactcccttgtcgcgaatggcatccacatactgacgacataccggcaaatcggtcgaatcgatgggcaactgttgacgttggcggcgggcaatcgccttttctgacagaaacttctcgggatgcttcagtgagtaggttgtggcagccttatctttcaggctgatgcgatacttcaacgtatcctgttgtgccgatgcctccaaggctacgaaggctaaggcaataagtgctaattttttcatttcgtatttttatttttccgtttttattcccagtttttgttttgttctatcaccaatccgatgccgcgttgcgaagcgataaatgctccacctatcactcgccgtccgtcatagaacacggccgactgtcccggagcaatcgccgaggcttctgcaagaaaacgaaccaaaaggcgtccgtcttcaagccttttcacccggcaaggaatcggacggctacggtaacggatacgtactgcgagttccgggcacgaaaacagttcgtcctcatccacaatattatcttgttccgccaccatatatccggctttcaactgttcggcatcccccagcattacagtgttcttctgcggattaattttcaagacataagccggtttgcccagtgcgatctcgagtcctttacgctggccgatggtataataaggaaaacccctatgttgccccagcttcacgccttcggaactgacaaaccatcccggaccgatctccgcatcaagttccgggcactgttcacgaagaaagtcccgataatcacctttaatgaagcagacttccatgctttccccctctttcgacttggcttcgtaacctttctcacgcagatagtcgcgcacagtctgcttggtgtagttgcccaaaggaaagatacagcgtcgcaggacgtcctgccccaatcgccagaggaaataggactggtctttcttttcatcatcaccggcaacaatatagatgtacccgttccgttcttccaaccgggagtaatgtccggtggctatccaatcacagcccagtttgtcagcccattctatcaacatgcggaacttaaataacggattgcacatcacgcaagggttcggcgtacgtccctgccggtactcgtctataaagtttttgacaatagtatctttaaaaggaacacgttcgtcggccacataatgttctatccccatacgtactgccaactctctggcgtcctgcggctcatcgccccagacacgcatggtgacacctactatctcgtatccctgctcttgcagcatcaggcaagtggcggtactgtctattcccccgctcatgccgacaagaacacgtttattgaattctttcatattcattctctttttacgaagaatgcaaatgtacgagattcccggcagaatacaatcaattggacaagttagtatacaaactttaaaactaaaggatgtatgatcaatgcaataccatgagggtgtgtcgaaacttctttcaccacggagtaacacagagtatcacagagtctttttattgataatcaacaacctaaaatcgtctctgtgttactctgtgtactctgtggtgagttttgacacagtccccttttgtctgtttgtcaaattgataacagaacctctccacgtttcagtttttcgaagctccggcaaggttcatggagaaaaacggcttatttccggttaggagattatccttttggcagggaatcaggaaagagataagccgtgagacagaaaaagaaacaaaaccggaacatagggacagtgcaacaagagatacaggttctttttattacttcagcaagctctcttttccactgacaaccagagaagattcaaacacttcggaggccagattccggcacaataggagttattaggaaaaacatatagagatatttggaaaacatataagcattttcggaaaatgtaaccgtcttttggaagaaatgcttccttctttttcggaaaaccaaccgtcttttacccccaaaccccggctctaatctttcaaaaccccggctttccgtcatcaaaagcaccgttcttctgccgcgtcccctccagtttgcagttccggaaggaaagggctgttagcaaaaacagtattatcattactttttgcacacaaaacaggctgagatatatcaaaatcacaatttcatttaatcagcgcagacaatggttctcttctccgtcatttccatctgtcattgccgggaagctccaaaatgttattacattatctttactctttccgcaataataaaagagatacaagaaatacgaagaataaaaaaaacagctaaaaccatttgctttcttcaaaaagaatctgtatatttgagtaataagaaactcagatatggcaaacccaaaactaccgggaatacccgaagctgaacaagctctgttgtatgccaaactgaatgaatacaacgggggccgcatgtcctacaaagaggcaggagcctactttgtggttctgccgagaccgggacatcccacctattcggtttgggtttactctccctcacttgaaaagaacagacttctgtttatccacgagctttctgccgacatcaacgaatcattacgaatggcaagtacgctgtttttcttctccagacgctgtctgctgattgtggaatacaatgaaaagagaatgcaaaacaatggagacgacattatatcgttcggcaaatatcacggacattatttacacgaaatcctgaaaatcgatccggcttacctgagttggatagcctacaaatacactcctaaaatcccgaaacaggagcgttttgttgcaatcgcacaagtataccgctcggtgcatctggacatcatgcaacgaaaagcacgccaaaagcgggaaaccagtcgctttctgggtaacgaaggggaaaagttagagagtctgaatctcaaagtagtgaaggtacggcttgaagacgatccatataaaacaagggtcgtgggaagcgccgttcagttctttgtacggcagatagtgacactgaccgacccatcgggaaatctggtgatcatgaagatttcctcaaagacacccagtcctgtatcttgtcagctcccggccctggaacatgaattccgtccaggtgaaatagtccacatcgcctcggcaagggtagcgcgcacttacgaaagttacggctcaaagtatacacgtttgagccatgtgaagtttcgtcaggtaagttaacgctttgtccagtcgtcttttacataactggacggataggaagtagagtctactatcccgcctttctgacgaatccaggtatcaaacgtacggctaccttcgttcaacacaataatgcgcgcaccattaggcaaatgattgtactctgtattaccaccggtaaaacgaccgtaggccaaaaggatgttcttccacatcacagcataatcgttatcgtgatcatgtcctacgaaaacacccatcacatcgcccgcctctttcatggcagcaaacataccggtattcaatttcggtgcgcaggctttctccatacgggtaccacgaagaatggcattttcattggcagcagcttcattatactccggaaggggaatatggaaaaaggccagtgccggataaggtttgccaccgttctgcgctgtataagcggcgctttgatcacgataccacgagatctgaccgaaagtcagccatgcatatccgtctacatccttgagtgaagagtaagaatgtgagtccatacaatagagcaatgcgacatcctttacggcatcggcagaggatttcactgtcagtacatagtcgggcgaaggagaagcgccacgatcgggcaacaaattgccgggtacaccacgaatcaggtcatagagttcggcacgggtctttccctgttcattatcatggttgccaaaagtaacaacgaacggaagcttacggcgttccacttgttcaagtacctggagcatacctttatcggcaggagaagaataaacaacatcaccggtgaaaattacgagatcgggatgttcggcatccaacacttcccctatacgctcaagggctatatctgaggccgggttgccatacttaaaatgtacatcggtaaactggacgattttaaatttaccgtctttattgaatcgtaagacggaactttgggcaacaccatcatttattgccatgaaagaaaacaaaacggccaataaggtcccaagaatctttttcatactatattacgtttaggagttgaatttaatcacacgcgattgatcagcacggttgcataagcggagatgccttcttcccgcccggtaaaaccgagcttctcggtagtagtggctttaatcgagatatcatccgcatcaatgcccatcacttcggcaagcacctgctgcatagaagggatatgggcttttagtttaggacgctccgcacagatcgttgcgtcgatattacctatttggtaccccttggtggcgatcagttccactgttttcttcaataaaatcttgctgtctatattcttatactcaccggcattgtcggggaagtgatagccgatatcgcgcatattggcagcacccagcaaggcatcgcaaatagcatgtaccagtacatcggcatccgagtgtcctaacaaccctttttcatgttccaaaagaatgccccccaaccaaagttcacgcccttctaccagttggtggacgtcgaaaccaaaacctacttttattttcataagagttatttttatagatgaataaaggaattcccggatttaccggatatagaaatcgagcaacttctctgcttcaagatacccctccaagtgctggccgatactgaccggacccactcccacaggagtcccggtaaagagcaaatcgccgattttcagggtcacaaaacgactgacataagcaataatatcatctatcttaaacagcatatcagccgtatccccttgctgcacggtgtttccgtctatatccagatgaaaacggagattctgcacatcggcaaagcgttctaccggtacaaatgtaccaatcgcagcggaactatcaaaacctttgcacaactcccaaggattgccggctgcacggaactgacgctgcaaatccctcgcagtgaagtcgataccgaccgttagtgcatcgtagtaacgatgagcgaagcgcggagcaatattcttccccaagcggttgatacgtaccaccagctcggtttcataatgcacttcatttgagaaatcgggaataaagaaaggcttcccgtctttgaggatagccgaatcgggtttcatgaagattaccggctctttattctccaacgtatgtcccagctcttcgttgtgccgggcataattcattccaacagctataatcttcatgatctattctgtttcattaaagttcaaacggttaaacatgacagcaagatgggcataaagtgacgtattctgcaccacaatatcttccgggacgcgaatacggaagggagtaaaattccagacggctttaataccaccggctaccatcgtatccgtaatgcattgggcaatctcgatgggcacagtcagcacaccgatgtgtacaccatactctttcatcttctccagaaaatcatcggaatggaaaatcggaatgccattaagcgtagtacctaccaatgtcgggttcacatcaaaagctgccacaatctccagaccgaaatggctaagaccggagtcacgtagcaacgctcctcccagactacccacaccgaaaaggaaagccttgtgcatattcgtaaagccaagaaaatcttccagaacagcaatcagcgcatctacctcataacccacacgagtacggccggaaatattaacatacgacaaatctttcgcaatctgtgaagcatcgatgtttatttctttagatatctgagtggaagagacatagcgttcgcctttctgcttcagcaactttacattcgaaagataccaaggcaacctacgtaaagtaggctccgggacctttgtactgtctttatgctgtatctgattattcatagtcacttcattctgcttttacattagcgattgacaaaattacactattttttccgaaatgccataaggatgtcatagaagcttaacataatttctacatacaaaaacgcccggggacacttaagagtttgcaaggttcggaacaatatattatttttgagcttaattaatagactggaaaaatgaagaacagcgattggaaagaccggctgaacgtggtttactccactaacccggattataattacgaaatggatgatgacgaagagcaagtaaccctggaaccgccacaacagaacttacgggtacagttggaccggaagaaccggggcggtaaagtcgtaaccctgattaccggctttgtcggcaccgagaacgatctgaaagatttgggaaaactcctcaagacgaaatgcggagtaggcggatcggccaaagacggagagatgatcatacagggagacttcaaacaaaaaatagtagaactactgaagaaagaagggtatacgaaaacaaaagcagtaggaggataaatccattcactttatgcacaaaagcactgtcccggattctgtataaacagagaaccgcaacattatggacagccacaaaaaaacggccgctacagagtttctgtgcggccgtttctatatacttgattccttgagattattcagctctcaaagtgaaacgtttgaagtcaacgactttcaattcaggatcagcttctttcaacacttctctcactgtcttcttggcatccatgatatcttcctggttcagcaagcaaacttcctttaagaacttgcccaaacgtcctttagcaatgttctgaatcatttgttcaggcatatttgcagccttttcagcagaaacagtagcaatgatttcttttgccttcgcaacatcttcggctgtaatccagcctttagccatattgctttccatgtggtcttcgctgtccacatgagtcggattgatattggctttcttcaaagcagcttctacagccttctgtacctgttcaacttttgtcttctcaatggcaacttcgatttccttctgcttcacttcttcagaaacaccatcctcgtcaactgcaatcggattcatagcggcaacctgcatagccacttgcttagccagctgttcgtcaacattcttattgaaagcaaccatagtgcaaaggccgtttctgttcatatggttgtaagcagaaattgtagcaccttccaaaaccatgtagccatccagttccatcttttcaccggtaataccgcttctgtccgttacagcctgagcaacagtagcgtcacccatcggaagagccaaaacttcttccagagttttgcacttgttagctacagcagcgtccagaatatcctgagtaagtttcacgaaatcagcattctgagcaacgaagtcggtttcgcacttcaaagcgatgatagcaccaaagccattttcaacttttaccagaacacaaccttcagaagcttcacggtcagaacgttttgcagcaactgcctgtcctttttcgcgaataatcttcattgctttgtcgaaatcgccctcagcttcagtcaacgcgttcttgcagtccatcataccagcaccggtcattttacggagcttggttatatcagccattgttacagccataatatcttttatattttaaaatgaataatcgtttgaataaacaaaatgtgccaatctgccaatcaaaatgccaacacccttacaggtgcaccggcacattagcaaattggcacattattatattaagcctcttcgtcttccttcaggaaagcagcagctttagctgcattaattgcttcttcgtcagatttatcgagtcttgccttagctgatttcttcttgcctttgttagcaggggcttcaccggcagcttccatatcgatcttctcagcttttctttcttccagaccttcgatcattgcagcgcagcaagcatcgagaataacttctactgatttagtagcgtcatcatttgccggaataacgaagtcgatgtttgtaggatctgagttagtatcaacgataccaaatacagggatacccaaacggttagcttcgcgaacagcgatattttctttcattacgtcgataacgaacagcgcagacggcagacgagtcaggtcagcgatagaacccaaagtcttgtccaacttagcacgctgacgagaaatctgaagaacttctctcttagacaaatttgagtaagtaccatcagctgtcagcttgtcgattgtagtcatcttcttcactgccttacggatagtagggaagttagtcaacataccacccggccaacgttcgataacataaggcatgtttacagatgcagctttttcagcaaccacctgtttagcttgttttttagtagcaacaaaaaggactttcttgcctgattttgcaatctgtttcaaagcttctgcggcttcgtcaacttttgcaacagttttgtggaggtcaatgatatggataccattgcgttccatgaaaatataaggagccattgcagggttccactttcttttaaggtgtccgaagtggcaaccggcttccagtaatgtatcaaaatttgttcttgacatcttgttttttctttaaatcgtttactttcttttttgttttttctaaaccaaccgccgggtagcctgtttaagagtcccggtagtttagatactaaacatattccgtcagacagcccattaacgcttgctgaactggaatcttctacgagctttcggctgacccggtttcttacgttcaacagaacgcggatcacgtgtcatgaagccttccgaacgaagagctgacttatcttcagcgttgatcttaaccagcgcacgggcaatagctaaacgcaaagcctgagactgaccagtgaaaccaccaccacacagattaaccttaatgtcatacttctcagcaacaccaagtttgttcaatggttgtttaacaacatactgaagaatagttgatggaaagtactctgcaaggtctctcttgttaatagtaatctttcctgtaccttcgcttacgaatacgcgtgcaatcgcacgtttacgtctgcctaatgcatttactacttccattatatcttatttaagtgagtttatatcaattgctttcgggttctgagcgtcgtgcttgtgttcgctaccagcgtatacatacatattgctcagcaacttagctcccaatctgtttttaggaagcatgcccttcactacttttctcagtaatctgtcttcaccgttaggtttggcaatcaaacgagcaggagtcatttctctctgaccaccgggatagccagtgtaagacaaataaactctgtcattccatttattaccacttaattttactttgtctgcattgatgataataacgttatcaccgcagtctacatgaggagtaaagtttggtttatactttcctctcaacagtttcgcaacttttgctcccagacgacctaatgtttggtctgtagcatcaacgataacccattctttggttacagttgccttgtttgcagaaatggtcttgtaacttaaagtatccactcttaatttgttttttaaatgttactactaaaaattttcttcaccacttatcaaccttccccggacaaaggaagattaacttgctatgaattaatctcttatccttttgagataataatcggcttgcaaaagtacggcttttctttgaattggcaaactatttctgcctttttttggatttatccgattgataacgagcaccaagctatcgactatgaacagcagccggcagacaaaaaaagagactgcaagtaacaattcaccactcaatcaacgccacaaggcataatcggcagcttgctacctgcagtccgtaaatccgttgttataatctgaattatcttacaatatcatccgggaatttatcaggcatctcaatgcgtttccaggtttcattataccagcagttcaattcattgccattcaggtccttctctataaagtatttaagatgcaagattttatcatcgataagttcaaaagtaagaacgttatcctgattatcgagcatcggcaaatgaatattcttttcaatactttcagcataagtatggtctgacaactgttcatagttgccatagccggttataatagcatccgatcccggacgaatcgtaaagttcacaattcttccatcatcactcagcactttgaaagtgttactcggtttaagcactcccggagcatccggactctctgaaacataatggcacaattgccagattcctttcagattagcaggtttaaagttacccttttgtgccatcacattcgttaccgcaaacagcattgccgccagcatggtaaaaaaataaagttttttcatatctgtacgattttagttaacactttaattcgtctgtctgtcacaaatataaagatttcttttataaaataagcaatcttaagacataaaaaaactcgcataatcaaaagaatatgcgagtttcttatcatttgtatgaatattcaggtatgattcatcaaaaatcggcattacgcggagtacgcgggaatggaattacatcacggatattagacatcccggttacaaagagcaataagcgctcaaatcccagtccgaatccggagtgcggacaagtaccgaacttacgggtatccagataccaccacatatccttcatcggaatatgcatctcttcgatacgtgtcatcaacttattgtaatccgactcacgctccgaaccaccgataatctccccgatcttcgggaaaagcacatccatggcgcgtacagttttgccgtcttcattctgtttcatatagaatgcctttatttcctttggatagtcggtcaagatcaccggacgtttaaagtggtcttccaccagataacgttcatgttcagaagccaggtcaactccccaataaaccgggaactcaaacttatgccctttggcaacagcttcttccaggatcttgataccttccgtatatggcaaacgcacaaagtcttctttcagtacaccttccagacgttctatcagccccttatcgaacatatcgttcaggaacttcacatcgtcggcacagttatccaaagcccacttcacacaatatttaatgaactcttcagctaaatccatattctcctgaatttcgttgaaagccacttccggttcgatcatccagaactcggccaaatggcgcggagtgttagaattttctgcacggaaagtaggaccgaacgtatagatagctccgagagcagtggcagccaattcgccttcaagctgaccagaaacagtcaagctggcctgtttgccaaagaagtcgtcatcgtatatgatagagccgttttcatcttttttcaggtcatacaagttcatggtagtcacttggaacatctgtcctgcaccttcacagtcagatcccgtaatgatgggggtatgaaaatagaagaatcccttttcatgaaagaatttatggatggcaatagccatattatgacgaatacggaatactgctccaaaagtattggtacgtggacgcaaatgagcaatctcacgcaagaactccattgagtgacctttcttctgtagcggatatgtattgtcacaagcacccagcacttcaatctcacgagcttgcacttcagccttctgaccggaacctaccgactccgtcaacacaccgttcacgctcagacaagcaccggtagtgatttgcttcagcatctcttcattaaagtttgccagatcgactacgacctgcacattatttattgtagaaccgtcattcagtgcgataaagttaacttgtttgctacctctgcgggtgcgaacccatcctttcacattgaccatagcgccaaaatcttcacgctttatcaggtcgacaatttttgttctactaatcttttccataaaactattttatatacattattatatatagtagtcagaagccagtagctggagaacaacaaacaccagactatcggcttccgactaccatcttttaaattcctttattattcaaaagatcccatccggaggaagtttacttcctgttccgtaaggtaacgccactcaccgcgacgcaatcctttcttagtcagtccggcaaagaatacacggtcgagtttcaccaccttgtagcctaatgattcaaatatacggcgtacaatacggttctttcccgagtggatctcgatacccacctgatcgcgtttcacttcatcggaatagctgatagcatctgcatgaatctcgccgtcttccaactggataccggctgcaatctgatccatatccgcctttgtcaggttcttgtccagatatacatgataaatcttcttcttcaggtatttcggatgtgtcaacttcgatgccaaatcaccgtcattggtcagcagcaatacacctgttgtgttacggtccagacgtcctaccgggtaaatacgttcagcacaagctcctttcaccagatccataacagtcagacgagcctgaggatcatccgaagtagtcacacaatctttcggtttattcagcaacacgtacactttgcgttcaatactgactgtttcgtcatggaacttcaccacatcggcacgcttgatctttgtacccaattctgtaacgacttcgccattaacagaaaccacacctgctgtgataaactcatctgcttcacgacgagagcaaactcccgcattggccagaaacttattcagacgaatcggctcattcggatcaacaaactgttctttgtattcaatctgtttcttcttactgtatttagcattcggatcgtaatctcccgtacggcgcaccggacgtgagaacccttgcgatctgttatcgttattgaatctcggacgataaggacggtcgccaccttcacgattgtatgaaggacgttgcggacggtctccataagaacgctgcggacggtcgccaccttcgctgttaaagcgcggacggtaaggacggtcgccaccttcacggttgtatgaaggacgttgcggacggtcgccataagaacgctgcggacggtcaccaccttcgctgttaaagcgcgggcgataaggacggtcgccaccttcacggttgtatgaaggacgttgagggcggtcgccataagaacgctgcggacgatcttcactattactattaaatctcggacgataaggacggtcgccaccttcacgattgtatgaaggacgattgtatccaccttctctgttataacttctgttaccatcacggccggcgtctgtattctcgctcttggagtcttcgcgccattcttcgttttctgtgctcattttcttattcgaataaaaattaaacttttggcctcacggcctgatttcaaacacttatattatatataacaataatcacccttaaattcccgtatacgaatggggagtgattactcttaattctttttttatttcctcactgacatccagtccttcgataaactccttgatcgaagcttctgtaatagcctgattggtacgagtcaatgccttcagggcttcgtacggatgcgggtaagcctcacgacgaagaatagtctgaatagcctcagccactacactccaacagttatcgaggtcacggcagattgcggtctcgttcagcaacagcttgcgcaatcccttcaacgaactctggatagcgatcacaatatgtccgaacggagtacctacattacgcaatacggtagaatccgtcaagtcacgctgcaaacgtgatacgggaagtttcactgcgaggtgttccagaatagcattagccatacccaagttaccctccgcattttcaaagtcaatcggattcaccttatgcggcattgcgctcgatcctacctctccggccttgattttctgcttgaaatattccattgagatatattgccagaagtcacggctcatatcaatcattaccgtattaatacgtttcatggcatcgaagatagccgacaggttatcataatttgaaatctgtgttgtatattcttcgcgttccaatcccagtttctctgcaacaaagcgatttccgaatgctttccaatcatattcgggataagccacatggtgtgcattataatttccggttgcaccaccgaacttagctgttacaggacatgccttcagagttgccaactggcgttccagccggtaaacaaaaaccatgacttctttacccaagcgtgtcggagatgccggctgaccgtgagttttggcaagcatcggaatagtttcccattcggcagcatatgccttcaactgagcaatcagttcctcaatcagcggataataaacctgctccaacgcctctttgatagagagaggaattgaagtgttgttaatatcctgcgaggtcagtccgaaatggataaattccttgtatttgtccaacccgcctaacttatcaaactcttctttcaggaaatactctacggcctttacatcgtgattagtcacactttcaatatctttaatgcgctgtgcatcggcttccgtaaaattacgatagatattgcgtaatgactcgaacacactcttatcaattcctttcagttgcggcaacggaagttcacacaaagtaataaaatactctacttctacctgcacgcggtatttaatcaacgcatattcggaaaaatatgccgctaaagcttcagccttgcctctatatcggccgtcaatcggagatatggccgtaagtaaatcaagtttcatattgtcgtttagataattatcaggttgcaaaattaactctttttcctgagttataaggcataaggagtgagaaagtttgtataaaagagactaaaataacgatgagtgatctatgacaaacggtgaacagcccgcattataatattgccgcaagcagttcaccgttcctcatttatcgctgatcacttattattccgtgtcgatcacagtccgtcaatcattcatcatcaattattcagtttcatcagcaccggtgtcttcaccgtcttcacctcggcctgaggaacttcattcaattgttcaaaaataacaatcttatttgttcctttcttcaaccatactcccgggatataaagggtttgctgcggtcccaccttccaatagcgcccgatgttgacaccatttacaaagatgataccttttccccaattttccatatcgataaatgtatctccgacgttatccaacgtaaaggtcccttcataaagcaccggacaacctttcagttttgcggcctcagcaggcacattcgcatgtgcatcagctttcagttttgccaggtcgggcatttcgctcatcggcaactgatacatatcccactcacctgtaatttccttacccgctatcttgaccggactaatgatacccttggtattatgcacaatttcactaccataattaatacgtcccatattttcaaccagtatctgcaaagtagcgttaaacggcacctcaatctccattgaataagtcttggtattccggttcaacacacctacctgctctccatccacatacacaaccgcatagtcacgcagtcccggtatctcaagcgttccactgataggttgattaaaatgacgggtatataacacatatccatacccttgattcaactgctcaaaagtcaaaggagtatcggccgacaccggcttttgcttttcggcgaatgccaatacatcagcaactttggtcaatttgatagaggggatctcaataaccggatttggagccggagcctcggggaccgtgtatttaacgtattttctgatcacgttacggattgaatcatacttcggagtcacccaaccagcttcactgataggagcatcataatcataactggtcagatccggctgaatatcacgtttcttatcataattagcaccacttgtaaagccgaaattagttcctccatgcaccatatagaaattgaaagatacgtcattctgcagatatttctcggtctgacgtgcaattccggaagcacccacctgtggaaacggttccgcccaatgcgacaaccaacccggatagaactcagcaaccatatacggtcccttaccatcatgatattgattaaccacctttttcaagttctcaatatcactttcgccattcgctgtaggcaaggcacccggtgtagctccgccttcaaaaagccagctgccatcagaggtaaacaagggtacattaaatcctgcgtcagccaattgctgtttaattttggcattataagcacgatgctcttccaaaggtatatcttttcgttgggcaacgtacgaaccaaactcgttctcacactgcaccatcacgatcgggccaccttttgtgcactgcaaatcgcccacttccttataaagccggtcaatatatgcctttgtatatttcagaaactccggattatctctcctgatttccattcctttcacattctgcagccaccagggatagccgccaaattcccactcggcacaaacataagggccggggcgtaaaataaccatcattccctcttcaccggctgtttttataaactcggccaaattcttgtcaccggtaaaatcccacttccccggctccggttcatgaagattccagaaaacataagtcgcaaccgtattcaaccccatacctttcatcatctgtaaacgatgacgccaatattgatgagggatacgggcatagtgcatttcaccagaaagaacaggtgtcacttttccattacgatagaaatgtccgtctttgatttcaaacgcagactttgactgcgagaatgcacataatggcatgatagccaatagcaaaagtaaataaatagattttgttcgcatggtagcattaataggtttgttgatgaagcaaagtaaagaaataaatcactttttcaccaactttcccgtcgttttcttataaaaaataacttgaattaatacaccgcaaccagatcagccataaaaaagaaagtcctcacagaaatattctgcaaggactctatgttgtgggcgttgacggattcgaaccgccgaccctctgcttgtaaggcagatgctcttatgataatggttaatctgctggatttcttcggtaatagtcggccggattctttcttaaaaaagaaacaacgaagcactgcttccacatcgctgtgtgcgaatggaaggttttgtgggggggcaagggaggaagacggttgttaaatgaaagagccatgctcccactattacaataacggagaagagtgggcagactcagcctcatccgagattctttatcgcccgaaattcttttggagagatacctgtattcttcttaaagaaatgtgtcaaataggattgatccggaaaatgcagttgctcagctatctctgttacagatagacggggttcattcaacagtacctttatttcagccaccaattgttcatcaataagctgcttgggtttctttccatctaaatgccgaactgtaattttatgcaggtaacgagacgatatacaaagttttccggcataaaaagctacctgatgttcatgcatactatattcgcggatcaattgcataaaccggtggcagagtaattgagtacggctatattgcttgctgacagccaacttttccggaatcgtattaaacagccacatgagcaaactttgcaaaaaattgtgctcttgttgtcctctgaactgcggcatcggttcggtaaacaacatttgtgccatatccatccacaaattgatctggcgccaagtcttctgacttcgttcgtcagcagtatgacggtaacagggatgttcgtgagtataattaaagtagggtgtatcaataggtaacatggcatttagaaatgcttctttaggaaacatcaacattttcacctgcaaatcctcggaagcttcaagcacttgtagcaggctaccggtcaggaagatcagttctgtctgttcattaaatatatatttctgcacaccggtagagacaatggcttccccccgcgtacaaatcagatagataccacaccggaaatgatatggagtcgatatcaaagaagtcagatcggtctcttcatatcggatcgttttcgtatcggcaagcaattggtctgttttcataaaagtctgttttaggcaacaaatgtaggtttattttttgtattcggactattttgttctgaaaacaacatattttgtacagattagcctacgtccggttcctaacaaatgaagtaattttgcgactgtattgatcaaagagaatagcaatgactgacagacagaattccagacggttcttattattatttttaggtgtattaagtgccttcggtccttttataatggatatgtatttgcctaccctgccggctatggcagattttttccagacttcatcttccatggtacaattaggactcacaaccagtatgattggtttggctgccggacaattaatcttcggtcccctgagtgacaagtacggacggcgttctccattacttctggctatgattctgttcctgctcgctacgctgggatgtatcttttcacacaccatttcactatttgtgctatcccgattcttacaaggcattgccggagcaggtggcgtcgtgatttcccgctccatagctaccgacgagtattcgggacaccaactggccggcatgctcgccattatcgggggaataaatggaattgctacagtcgttgcccccatcggaggaggtattctggcccagataacaggctggcaaggcatttttatctgcttattccttatgggagtggctctcctatccggaagtctgcacctgaatgagtcacttccgacagaacacagacaggctgtgagttggcaagccctataccatcgttttggggaagtcctccgcaaccgccgttatgtaggctacgtcctgcaatatggctttaccatgggaatattgtttgccaatatctcttctgcaccattcatcatgcagcaacactacggactctctcccctatcgttcagcctctgctttggaatcaatgcgatagcaatggttatctcttcagcaatatcgataaaattgcctactatggaacgggctttatatataggaagccggggcatgttgtcagtatctgcactgttaatggtgttcttgcctctgggttgtgatttttggatctacgagttattgatcttcgctctactctccatgattggcatgacttttacggcgtccaacacgttagccatggagtgtgagcgacggaatgcaggcattgcttcggcacttttgggagccaccgggtttgcatttggaggtatcgtatcgccgcttgtaagcttaggagatatgatgacctctaccggaatattgtttttagcaggttctgtttgtacctatgcgtgcacgcgatatgtattatcacgatccgctcagccctccggactgctatatcattgaaaactttcacattcaaatatcttttcctgacaaacgtcaaaaggaagttccaaatccaatacgacttacagaagataaagtcgaaacgtagcataaattacaattcacctataaacagacctttaactgcccaaacattagtttaaaagcaaaaggtccttcctttaaaaccaatgccccttcggttttaaaccaatgattcccttcctttaaaccacctataggaactctgcacaaatcacacttatacattcgatcgcccaggggggggggaagaagtactttatctatacatatctattttcaaaacacaaagaagagataaccgaaacggaaaatgtattgtctacactcagcagtttagaatagcagtcctcctaccccgtaataacgaaccgaaaaacaaaaagacgaatcaatccacacacaagttctttcgttttacatttatattctctacctttgtacactgaatcaatcaattactaaaattctaacccaagccgcatgaaagcattttttcatttatcatttattcttttattcgtattcacagcctgtacgtctgcccccaagcagacaaccactgattacacacaatatgtaaacccatttatcggaacagacttcaccggtaacacatatcccggagcgcaagcacctttcggcatggttcagcttagtccggacaacggactgcccggctgggaccgcatttcaggatatttctatcccgacagcacaattgccggattcagccatacccatctttcgggtacaggagccggagacttatatgacatttcgtttatgcctgtcaccttgccctacaaagaagcagaagctccgttgggcgtctactccaaattttcccatcaggacgaaagcgccacggcaggatattatcaggtactgctgaaagattatggaatcaatgtagaattgacagccaccgaacggtgtggcattcagcgttacacttttcccgaagcgaaagccgctatcttcctcaacctgaaaaaggctatgaactgggacttcaccaacgactctcacatagaagtaatagattcggtgactattcagggatatcgcttttccgacggatgggcacgaaatcaacacgtatacttccgcacccgcttctccaagccttttgctgccgtacagatggatactaccgccattatgaaagacggtaaacgaataggtaccgctactgtagcccgtttcgactttgacacggaagacggtgaacagattcttgtcaatacagcactgtcaggcgtaagcatggaaggtgccgccaagaacctgacagctgaagtgcctgaaaatgattttgaaaaataccgtgaggctgcccgtgacaactggaataggcagctctctaaaatagaaatcaaaggtgacaacaaagacgaccgggtaaacttctacactgcgatgtaccacagtatgcttgcccccaccatctacagcgatgtggacggtgcttactacggaccggataaaaagatacatcaagcagacggatgggtgaactacagcactttctcactgtgggatacatatcgtgccgcacatcctctgtttacgtataccgaaccggaacgagtgaacgacatggtgaaatcatttcttgcattctacgaacagaacgggcgtttaccggtctggaacttttatggaagtgaaaccgacatgatgatcggttatcatgccgttcccgtaattgtggatgcttatttaaaaggtataggcaatttcgatcccgaaaaagcactggaagcctgtgtagttaccgccaatctggacaactatcgcggaataggtgcttacaaaaaactgggctatgtccccttcaatgaaaaagacagttataatgccgaaaactggtcattgtctaaaacactggaatatgcctacgatgatcactgcatagcccgtatggcagaaaaactgggaaagaaagagattgcggacgaattttataagcggtcgcagaattatcgcaatgtgtataaccctgccacctcgtttatgcagccacgtgatgacaaaggagaattccagaaaggttttgaagcagacgcttatactcctcacatctgtgaaagcaacggctggcaatacttctggtcagtacaacacgatgtagacggactgatcagcctggtcggaggaaaagaacgctttacccaaaagctggacagcatgttcaccttccatccctcggctgatgacgaacttcctctgttcagcaccggaatgatcggacaatacgcacacggcaatgaacccagccaccacgtcatctacttatacaatgcagtaggtcagccttggaagactcaggagtatgtagccaaagtgatgaacgaactttatcagaacactcctgccggactttgtggtaatgaagactgcgggcaaatgtctgcctggtatgtattcagcgctatgggattctatcccgtcgatccgataagcggtaaatatgagataggcactccccttttcccggaaatacaaatgcacctcggcaacggaaaaacattcactgtcaaagctcccgcagtcaacaaggaaaacatttatatcctgtcaaccaagttgaatgggaaaccctatgataagagttatattacacatgaacagatcatgagtggtgcaacccttgaatttgagatggggaaaaagaggtaatctgtagctaaaaagatggacgatacatttgacataacctacaaagcactgtttcgcaaatactatccgaacctgatattctacgccacccgcctggtgggtgacgaagaagcagaagacgtggttcaagacgtatttgtggaactgtggagacgaaaagactccatggtgataggtgaccaaatccaggccttcctttaccgggcggtatatacccgggcgctgaatgtgctgaaacatcgcagtatagaggatggatactgcgccgctgtggaagaaatcaaccagaaacgggctgaattctaccaaccggacaacaacgaagttatccggcgaatagaagaccgtgaattgcggaacgaaatctacgaagccatcaatgaactgccggacaaatgtaaggaggtattcaaactgagctacctgcacgaaatgaaaaacaaagagatagctgacgtaatgggagtatctttacgcacggtagaagcccacatgtacaaggcgctgaagttcttacgcagccgtcttagccatttatggcttttattcctattattttttatcaaatagataagtgtttttaaagaattagttgtttctattatataatgaaaaagaaaagatgaataatctgagcgaagaaatattgatgagatatctgacgggcgaatgttctgacgaagattttgccagagtaaacgcttggatcaaggaatcagatgacaatgcccgccgacttttccggatggaggaggtatatcatctgggcagacacgacagcttcccggatcagaaaagaacagcccgggcagaagcacgactatgcaaaaagctggctcaggaggaggcacatagccgcaaagttatcagaatgcaccaatggatgcgatatgcagccatcatcatactggctttgatggtcggtgccggaggcggatatttatattaccaggctgaccccacccgggatatgataacagcttcatctacggacggaaaagtgaaggaaatagtactgcccgatggcagtaaggtatggctgaatcagtcggcaacgctgaggtatccacgagagttctccaataccgaaagagatgtattccttgacggagaagcctactttgaggtcactaaaaaccgccaatgtcctttcatcgtagaaagtgaagcaatgcgcatcaaagtattgggcacgactttcaacttcaagtgtgacaaaagccacaaactggcggaagcgacattaatcgaaggagaaatagaggttaaaggcaacaatgaggaaggaatgatcatcctttcgccgggacaaaaagccgaactgaataaaacaacccgccgactggtagtgaagcaggtagatgccaaactggatgccgtatggcacaatgacctgattccgtttgaacaagccgatatctttgccatcacccggacactggaacgtttttatgatgtgaagatcattctctcacccgatataaagtcagacaaaacttattcgggtgtactgaaaaagaaagataatatagagtctgtactccaatcactggacaactctataccaatcagttataagatcgtgggagataatatttttatttcttcacgtaacaagtaaacaactaattaaaataaacatatagtaccatgagatttagaacattcctggcgggatgtttaggaggcttattgtctctgaactcctgcacaaactcgccggacatgactgattatgcagcctatgtcaacccatttatcggtaccggcggacacggccacacttttccgggcgctatcctgccccatggcatgatttcacccagcccggacacccgtatagatgggtgggacgcttgttcgggctattactatgcagactctaccatcaacggattttcacacacccacctgagcggaaccggttgttgtgactatggggatgtgctgctgatgcctacggtaggcgaacagaaatatctcccaacaggttcacagagccagaagatggcttatgcttccagcttttcacaccagaacgagactgccgaaccgggctattactccgttttcctggacacctatcaggtaaaggccgaactaactgcaaccaaacgggcagccatccacagatacactttcccagaaagtagagaagccggattcatcctcgattttgactatagcctgcaacgacagaccaataaagagatggagatagaagtcatcagccctaccgaaatttgtggacgaaagaaaacaatgtactgggccttcgaccaatacatcaacttttatgcaaaattctcaaaacctttcacttatacactggtaaccgactcgatggcgcttgacgaaggaggtaaattactgccgacctgcaaagcactgctacactttaacacggcaaaagacgaacaagtatttgtaaaagtcggaatatccgccgtggatatagaaggcgcacgcaaaaatgtggaagcagaaatacccgattgggactttgacggagtacgtaaggaagcacgcaaagcatggaacaaaactttgtcgaagatagatatcaccacgaatgacaaggatgataagaccattttctacaccgcactttatcacactgccgtcagcccaaacctgtttacagatgtagacggacgctatctgggcatggacctacaagtacatcaaggtgacacgcttaatccgatgtataccatcttctcactgtgggatactttccgtgcacttcatccgttgatgaccattatcgatccggacctgaacaatgactttatacgttctctgatcaaaaagcaacaggaaggtgggattttcccgatgtgggacatggcttccaattataccggtacaatgattggctaccatgctgttcctgttattgtagatgcgtatatgaaaggtgaccgcaacttcgatattcaggaggcttatcgtgcgtgtgtacgtgcggctgaatatgatacgacaggaatcaaatgtcctgccctggtgctgcctcacttgatgccgaaagcaaaatattataaaaactcgatcggttacgtgccatgcgaccgcgaaaacgaatcggttgccaaagcattagaatatgcttatgatgactggtgcatttcaatctttgccgatgcactgaatgactatgacacccgggataaatatgcccgctttgcgaaagcttatgaattctacttcgacccggaaacccgttttatgcggggactggacagtaagggggaatggcgcactccgttcaacccacgttcatctactcaccgcaacgacgactattgcgaaggaactgcctggcagtggacctggtttgtcccccacgatatcgaaggtttggtgaaactgatgggaggtgaagatgcctttgtcggcaaactggattctctgtttaccgccgactcctcactggagggcgaaacgatctcttcggatatcagcggactgatcggccaatatgcacatggaaatgaaccaagccatcacgtgattcacatgtacaactacgtgaaccgcccatggcgaactcaggaattggtagacagtgtataccgcagtcaatatgccaataccgtagacggactatcgggtaatgaagattgcggccaaatgtccgcttggtatgtactgaactccatgggattctatcaggtatgtcctggtaaaccggtttattccataggacgccctgcatttgacaaagctgtggtcaatctgcttgatggaaagaaatttatagtaatagccaagaataactctaaaaagaataagtatatcaaaagcatgaagctgaacggggaaccgctggaaaagcctttcttcacacatgatgacattgtggcgggaagtacactggaaattgagatgacagatcggcgaccgcaaccctaatctctctcaggaagagggaacagagagggtgtgtcaaaactcaccacagaggacacagagtagcacagaggtgatttaagttactgattattagcaaaaagctctgcgatactctgtgttactccgtggtaaaaagagttttaacacagccccatgtaatcatagtagatagaaattacataatattcatttaataaaaaaggtccggagctatatcaaaagccttttcaccacagggtcgcacggagtgttcatatgaatcatccatgactttgcttttgctctgtgtcttctgtggcaagatttgacacgtctccgagacctcttattcacaccatgaaaaaaattcttttgaccgcttgccttgtagcttgctcattgatggctaaggccaaagactggacccaatatgttaaccccttgatgggaacacagtcctctttcgagttatcaaccgggaacacctatcccgccattgcccgcccgtggggaatgaatttctggacaccacaaaccggtaagatgggagacggatggcaatatacgtacacagccaacaaaatcaagggattcaaacaaacccatcaacccagtccttggatcaacgattacggacagttctccatcatgcccataacaggcaaaccggagtttgacgaagaaaaacgtgccagttggttcagtcacaaaggcgaggttgccactccggcctattataaagtatacttggccgaacatgatgtcgtgaccgaaatgaccccgacggagcgtgcagtcctgttccgcttcacttttcccgaaaacgagcattcgtacgttgttgtagatgcgttcgacaagggttcttacgtaaaagtaattccggaagaaaataaaatcatcggctataccacccgtaacagtggcggagtacccgagaacttcaaaaattactttgtcatcgagttcgataagcctttctcttacaaaggcactttcgctgataaaaaactggaagaaggcagtctggaacagaaagccgatcataccggagctgtcatcggtttccgcacccggaaaggcgaaatcgtacatgcccgcatagcctcttcgttcatcagtttcgaacaagcgactcagaatctgcaagagttaggcaacgactcctttgaacaactggtacagaaagggaatgatgcctggaatcatgtattgggcaaaatagaagtagaaggcggcaatctggatcagtaccgtacattctactcctgtctttaccgttctctcctgtttccccgtaaattctatgaactgacagcggacggtcaaccgattcattatagtccctacaacggtcaggtgcttcccggatatatgtacaccgataccggattttgggatacattccgttgcttgttcccattcctgaacctgatgtatccttcggtaaacaaagagatacaggagggactcatcaacacgtacaaagaaagcggcttcttcccggaatgggcaagtcccggacatagaggctgcatggttggcaataattcggcatcagtactggcagatgcttatctgaaaggagtgaaggtagatgatgtgaagaccctgtacgagggattgattcacggtacgaaaaacgtgcatccggaggtctcttctaccggacgtctgggctatcaatattacaacaaactggggtatgtcccttatgatgtgaaaatcaatgagaacaccgcccgtacattggagtatgcctatgatgactggtgtatctatcaattgggtaaagcattgaaccgcccccaaaaagaaatcgaacagtttgccaaacgtgccatgaattaccggaatgtattcgacaaaaaaagcaaactgatgcgtggccgcaatgaaaacggacagttccagtcaccgttctctccgctgaaatggggtgatgcttttacagaaggcaacagttggcattattcctggtcggtatttcatgacccgcaaggcctgatcgatctgatgggaggtaaaaagatgtttatcacaatgctcgattccgtatttgccgttccgccggtgttcgatgacagttattacggacaagtgattcatgagattcgtgaaatgacagtgatgaatatgggcaactatgcgcatggcaaccaaccgatacaacacatgatttacctgtataactatgccggacaaccttggaaagcacaatactggcttcgtcaggtgatggaccgcatgtatactccgggacctgacggctattgcggtgacgaggacaacgggcagacgtctgcctggtacgtattctccgcactcggattttatcccgtatgtccgggtacagacgagtatgtcttaggagctccccttttcaagaaggcaactctgcattttgagaacggcaataatctcgtgatagatgcaccggacaacagtaaagaaaacctgtacattgaatcgctccgtatgaatggaaaggaatcatcacggaactatttgaagcacgacgatttgctgaaaggtggaatccttgagttcaagatgggatcacagcctaatctcaacagaggtattagcgaagaagacgctccgtattcattctcaaaagagaaataagcaactccacttgtcttagaggcagtcgatccacctccatttaaatggtggatcgactcaacccaatgggaatgcccctactcattaggctgaatatcctcctactcattaaactgagtcgcccccatcccataataaaggggagaaaagcccccttcgaaagtccctcctaaataaatctcaaaaaagtcagcaactgaagtaagtgtttctttcgggatacttgttttattaacatcaagggcacaaaagccacttgatttacattataaataccatgcttaaaccttgtatgtttttaaagttaactaattaatttaattatagtcaatgaaaaacaaaactctgtttcaaagacccaagctgctcaaagcatcgctggttattcttttggctgctgctcctattcagtggtcattcgcacaattcacattttcgactccccgcactacattggggcaagtgatcaagacagtgcaatcccaatctaagtatcaattcttttatgacgatcaatcgtcgaacatgccgattgagaatctggaagtaaagaatgtaagtctggaacaactgctgaacactgcacttaaaggcaaaaacctgacatacaaaatcgaagataacattgtttatctgtctcaggctgccaaacagcaggatccggcacaaaccccgatcaaacggcaggtcagcggtacggttgtagatgccaacggcgaagcactgatcggtgtaaacgtatccgtaaaaggtaccagcacaggagccattaccgatttggaaggtaaatacaccctgacggtcaacgatccgaaagctgaaatcgtattctcctatatcggatacaaacaacaagtactgcctgcaaaggaaagcatcctgaacgtaaccatgagtgaagatacccagatgatcagtgaagtggttgtgacagctttaggtatcaaacgtgaaaagaaaatgttgggatacgccgtacaggaaatcaaaggtgaccaactgaaccagaccggagacccttcggttaccagtgcattgcaaggtaaagtagccggtctgcaaatgaacacggccggtacaggtcttggcggttctaccaagatcacgattcgtggtaactcttctctggctgacaacaaccaaccactctggattgtagacggtgtgccgtttagcgataacaataactcggatgctacttactacggcggtgttgaccgcggtggttcttccgtcgatatcaaccccgaagacatcgaatcgatttctgtactgaaaggtccgaatgccgccgctctttacggttcacgtgccggtaacggtgttatcttagttactactaagaaaggcagcaagaaagacggtttcggagtgcgctatagcggtaacttcacttggagtcaagtagccgaaaccctcgagatgcaggatcgctatggacagggacacattgtgacccaggatgagaacaagaatccgctgtctcaatattacgcgaaatatgatccgacagactcctcaagctggggaccggtattggacggaagcatgcagaaagcctggaacggcgacacatatgctttctccaaatacggaaacaaactgaaagattatttcgataccggcttcgcacagaaccacaatgtatctgtaagtaacgttacagacaaatcacatttccgcgcttcttttggtagttcaaacaacaaaggcgtattcccgaacgaaaaactgaaccgaatcaaccttgacctgaatgccggaatggaaatgaacaagtatctttctatggatggaaagatttcactttcacgcaccaaagcagaagaccgcccctatttcggtacatacggagccatcgctcaattgatgggtattcctaacaatatccgtctggacgatctgaaacaatactccacagccgacaatgcacacgtgaactggacaggtcctactgccggtatccgcaatccttattacgttctgaaccaacgccacaactctgacgaacgttggagagccttcggttactatggaatgaaaatcaactttaccgactggttgcacctatccgccaagtatgcattcgactattatcgtacccgaatcgaagaaactaatgcgggtgacggtatcaacggcgaaagcagtatcaaagatatcacagacgatgaaatgaaccgtgaagaacagaacttcttcgaatcgaacgcggaaattgtattgatgggtgacaaacaattgacggacaatttccgtctgggcttcactgtaggcggtaacttcatgtaccagaactacgagtcactgaatgccggtgtacgcaatatgcttgataaaggacagtggattttcaatgcagccaatatgctgaacacagcgggagaaacgggccatgaacgtgctactaactctgttttcggatctctgcaactctcctggaaagagtatctgtcactggacctgactgcccgcaacgactggtcgtccacactgccaaagaagaacaactctttcttctatccgtctgccaatttgagtttcgtcgtgtctgattttgttcgttcactggacaagacattaccaaactggttaacttttgccaaagtacgtctgtccgcagcacaagtaggtaaggatacagatccgtatcaactgtataacacctacggattcaagttcgaaaagggtgaactgatcccaagcaaatcgaacgtgaagatgaacgaccaactgaaaccggaaatctcttcatcctacgaagcaggtctggatatgaagttcctcaacaaccgtctgggatttgactttacctattattacagccgtacgaaaaaccagatcatgaaagtgcctgccgcagctccttggagtggcgggaaatgggtaaatgcaggtttaattaccaacaaaggtttcgaaatgatgatttactcgacaccggtacaactgaaagacttctctttcgacttaaatgtcaatctggccaaaaacgtatcgaacgtagagaaactggctgaaggtgtagattacatctacttcaacggtgactcaaacttcccgatcaacgtaggtgcacgtccgggtcataaactgggtgaaatttatgctaagaccctttacaaacgtgacgaacagggcaacatcatcatcaacaaagaaaacggtctgcctatgactactactgacgctgacgaacgcctggcaaaacccatcggaaatatccaacccaacttgctgatgtccgtatctccgtcattcacctacaaaggctttacactatcggccatgttcgatatgaagttcggcggtgacatcatctctatttctgaaatgaacgctacaggctcaggtatggccaaacgtaccatgaatcgtggtgaaagcgacaacttcatgatgatattccccggagtatatgaagacggaacgccgaatacccaaaagatttcagcttccaactattacggtgctttgaacgcggaagactttatctatgacgcttctttcatcaaactgaaagaattggctatcggctatacgttccctaaaagcatgttgaaaaagacaccgatcaactcgctgaatgtatcattcgtggcacgcaacctggcttatctgttgaaacacactccgggaacaagtcctgaaggtggttacgatacgaccatgttctcacaggccatcgactttatggccgtaccttatacccgtacattcggattctcagttaaccttggtttctaattttataaataaagatatagtatgaaattcaaaatatataaatcacttgccatgtgcaccctcctcttaggactggctgcatgtaatgatttcgaagaaatgaataccgacccctatgcgccggtatacgatccggaaataatcggtgccacccccgacggaatcgatattgactacgaactgacaccaagcgcgctgaaaagccttcaagggacggaaagtgccatcggttcagtatttgccaacctaacttacgaaggagtgtataacgactatcaggttactaccaatctgacccatgacatctacgccgcttactttgcaaacaatgtcagcggattcgtaaccaactcacctacttacggatataacgacggatggtccaaaaaacgttgggaacacttctacgataatcgtacagtagaagagtacagccagttgatcaaaacattctggttctgtggaaaggaacgctatcataacgcattctatatcacccgcatctactacgcattcctgatctctatgcagacagacacttatggagccattccattggaatactacgtaaagggtgcaatgcctacagacgaaaaagtgaagtatatggatcagaaagatgtatatgacgtcatctttaagatgcttgaccaagccatcactgcactccataacaccccatctaccgcacaatacagcttgggtgaaaacgataagtgctttggaggtgacaaagacaaatggcttcgttttgccaatacccttcgcttacgattggcactgcgtgtatcgaatgtagatcctcaactggctaaagaacagggtgagaaagcaatgactgatcctgccggattgatgcaaaacgatgacgacaacatgaagcagactcccaagtattcatacataacgggtggcaacgaaaacatctacacacttctgtacaactggagtgccaacgtagtgttatccaaagaaatggaaagagcttacaaagaacaatccaccattctcgacccgcgttgcgaaatcttgtggtggagaccgactgcccttgaaaatcttaatctaaccgaacccaaagaggatatgacgaaagatttcaatggttgtgaaaatggtgaaacttcattgggaggtagctatacaaccacttattctccgagtcgcgtattcatcaagcaagaccagaagaaactcgaccgtaaacattggtggtgctacgcacgtgaaattgtatggctgggttactccgagagtttattccttcgggcagaagccgctctccgcggatgggcaggtgcaaatggaacagctgaagaattatataaggaaggcatcgaagcttccttcaactactatcagattggcgctgacgaagaaggtcaggagaagatcaacaagtatatggaaggactgaaaggattacaagctttcaagagtggtgacagagaagcacaactggagcagatcatcacccagaaatggattgccgtatatccgaatggtaatgaagggtgggcagagttccgccgtacagactatccccgctacatgaaaacacctaaaggaggcaacaactcagggggtgaagtcgcaaacggcaagttcatcaaacgcctgagatacccggacagtgaagtgtccaacccgaaccgtccgaaagatgtagatacacaaggaactcgtttatggtgggacgtagccgacaccaatgatgatggaggcaattacgttactccaaacaatttccgctaaacaacgagattaatattcatgcactgacaatagattaggttacacaagagaaacagggagcccgagatgggttccctgtttttatgtatactcctgtcactctatttgttctttcggataattcaccaaatagagtgtcttcgatgcacgtgtgaaagccgtatataaccagcggaaataatccggcgtcagatattcatccgacatatacccctgatcgagaaaaacattcagccactgcccgccctgtgccttatggcaagtcactgcataagcatactttacctgcaaagcattgtaatgcggatctgctttcatctttttcattcgctcccgcttgacagtaatatccgcatagtcctcaagtacggaataaaaaagccggtcattttctgttttgggcaaggcaggggcatccgaatggagtgtatccagcaacaagtttgcttcaatttcaaaatcattataatccgggaatgaaagaaccacttcggcaaaccgaaaaccatacagttcacgagtacgtctcacccggcgaaccacggcaatctctccgttcgctatgaaatccatttctttatacctctcagtccagtaataattattcttcgctatcattagcaaatcacccgtattcagttcatcttcccggtaaagaatctgggcacgtatacctttattatatatattggcccgcttattggaacgacataccacaatcgtctcgtccatgccatctttttcgtaacatccggtcagggtctcaatcagctcgtcaccgggtactacctttatatccggaaatccactcacttttatcttaggcaacgagtaacactcctcttcagcaattaaccggcgtatttgggttgcattccataatataccagatgcctgtacctgacgcaccacttgtgtcagatcgacctctatcacattcagtccgtatcccttcaatgcctctgtaacaagtgcaggactttgctcttcccctaccggaggcagctgggctgtatctcccatcaacagcaaacggcatcctgcaccggaataaacaaactcgaccagatcatccaaaagccgccccgtaccaaacatagatcccgataaaccttcattcgaaatcatggaagcttcatctacaatatataatgtatgggtggtaagattatcattgattgaaaaattacttacttcattcgaaaatgactgctgcctgtatatctttttatgaatggtaaaagccggatgtcccgcgtaagcagaaaataccttagctgccctccccgtaggcgccagcaatatcgatttctgttgtaacttatccatcgctttcaccaaggctccgacaagagaagtctttccggttcctgcatatccacgaagcacaaaaaccgtctcattagccgtagaaagtagaaactctgaaagagattttacagctatttcttgctcaaaagttggctgataagaaaaattttccttaatttgccgctctaaatagttatttatcatttttgtacgagaaaaaagttacaagaactatcgttaattagatttatttattttatttttgcgctacgaatataaactaaaaaaaacatatttatcatgaaaacagtatttaatatcgtactaggtctatgcgtaattgctttggtttacatttgctatgccagcatcatgggtcctatcaacttcgaaaatgctaaaaagcacagagacaaagcagttgttgcccgcttgatcgatattcgtaaagctcaggcagaatatcgtaatatctacaagcagtacactgcaagctttgacacactgatcgatttcgttaagacacaaaagattcctttcgtatctaaagaaggcgtattgagcgacaagcagctggaagacggtatgactgaaaagaaagctatggctatgatcaacaaggctaaaaagactaacaactggaaagaagttgaagctgccggcttgatgggcttcaaacgtgatacaatatgggttgccgtaacagatactatctacgataagtcattcaatgcagactctttgagatacgttccgttcggtggcggtgcacagtttgaaatgtacaccagaaacgatacaactaaatcaggagctcctatcttcctgttccaggctaatactccgtatgatgtatacttgaacggacttgacaagcaagaaatcgcaaacttgaaagatgttcaaaccaaactgggtaaatatccaggcttgatggtaggttctattgacactccgaacaacggcgcaggtaactgggaataatccgaatatgcccgatagagcaattgcagaaacgattgactttagtaaatcggaacaatatacattgtccatccgtcttagtacggatggattttctttttctatctacaatccgattcacgatagttcgctctctttctttgagaaagaggtcgagccttcattatctcttacagccaacctcaaaaaggcttttcgtgaattaaactttctgaatcatacttacaaacgggtaaacatcctgatggcggacaaacgtttcacactaatcccccttgaactgtttgaggatgatcagtccgaaatggtattctaccacaaccacactcccaaagaaaatgaaacaataaaatacaatattttaaaaaagaataatgccgtagtcatcttcggtatggacaaaagcacttatcaattcttgtccgatcactaccctgaggcaagattttattcacaggcagccccattagcagaatatttttcaacaaaaagcagattaggcaacagtaaaaagatatatgcctctatccgccacaatgccatcgactttttctgttacgaacgcggacatctgcttcttgccaattcatttgaatgtcgcaaaacagatgaccgaatctactatctcctctatctttggaaacaactgaatttcgaccaggagcgagacgaacttcacctgacaggtgtatttgacgataaagagaaactaacgcaggaattacgtaaatacattcaacaagtattcataatgaaccctgcaagcaatattgacatgcaagccttattaacatgcgagtaatcagcggaatatataaaagaagaagatttgatgtgcccagaacattcaaagcacgtcccacaacagattttgccaaagaaaatctgtttaacgttttatccaactacatggacttcgaagacggcattgttgcccttgacctctttgccggtacaggcagcatcagcattgaactggtgtcgcgcggttgcgaccgtgtcatcagtgtagagaaagatggtgcccatcatgcttttatcagtaaaataatgaaggaagtgcagacggataaatgcctgcctatacgtggagatgtattcaaattcattaatggcagtcatgagcaattcgactttatttttgccgaccctccttatgaactgaaagaactggaaacaatcccggatctggttttcgaaaacaatatgttgaaagaaaacggactttttgtcctggagcatggcaaaaagaataactttgaggataatccccatttcattgaaagaagagtatacggtagtgtaaacttctcttttttcagataaactgcagaagatacactttacagcaaaggagcgagcaaacggactacggactccatcgctttctgcctccaggaacgcttctcccagttcttcaagaagatctgggtactttcccgttgatcctgtaaaaagatctcccgcatctgtagggcagtctccatatcgtacataaaggcatttacttcgaaattgtgttcgaaactgcgaaaatcgagattggtagaccccacggttgaaagcatatcatctgaaaccatcaatttggaatgcaggaatccctttttataaaaatagaccttgactcctgcccgcaaagcatctgccagataagaacaggaacctaagtgcgtcactcggttgtctgcatgttcaggcaacatcaacctgacatctaccccggctaatgccgcagtctgcatagcaaccagtatctgttcggtaggcaggaagtaaggagtctgcatatagaaatatttcttggcaccggatatggcaaccgtcaatccctgcatgatttctttccaaggtccaatcggttcactcgttacaatctgtaccaaagagttgccacaggcctctatcttaggaaaataacgtgaagccgtaatcaaggtacgatctacaaaataccaatccagcaaaaaggcagtctgcagaccatgtacggcctttccttcaagcattatatgcgtatcccgccaaattccccaagagaaaccgcgcatataacgttcggcaagattcattcctcctacaaatccgatacgaccgtctatcactacaatctttcggtgattacgatagttgaccttactcgtaaataggggaaaacgtactttcagaaaactccgcacctcaattccggcatcacgcatctcttcaaagaatctatgaggaacgtgccagcaccctacatcatcataaatcacacgtacctcaactccctcgcgtgccttctctatcaatacatcacgcaccagacgccccaccggatcatcttcaaagatataatattccatatgaatatggaatctggccttttgcagctctcgcaataaagcctgaagtttagaatatccgccggtataaatatccacccggtttccttcgaacggaaaggcttggttcgtgttctgaaacagttgtatcagacgggcatattctttcggcgtttcacagcagttctgtgccagatactctgccatcggctttttgagcaatcgattgtaacttttcttaccgataatcttctcacgccgctggctacgcccgaaaaagaaatagaaaaccaaccctacaaccggaaggaacataaggatcagaatccatgccattgtctttaccggattacgattgtcgagaatcacgatgacaatcgtaccgataatagccccgaaataaataatatcaaaggcaacggtagctattacgcttgctatgtagttccaatctatcatattcaccctccgcgtattatacaaacaacaaatgtatggaaaatatcggatacggacaacaactgtcccgattcaaaacgacaatccctccgaacagatgcaaaattaaagagattttgcaatctatccggagggagttatcaggtcagtcttttattaaaaatgaggacgtccgcctccaaaaccgccgggacctctaccgggtccgccaaatcctctacgtccgccgctattcatcatcttttcacgggccgctttactaccaaagatattcaggcgataaatgaagtgtaccatacagtaactattgataccattatattcggataccgaacgcatatcggctgtcaacgaacggctgatgttgctctgctgcctaaggatatcatatacttcaaaactgatagtacctgcacctttcagcaacgactgcgcaagttgtgcattccagatcagttcattacgattcatactcgaatcacgataaccacgacggctttgattagtgatgttagtagccaaggtcatcttccagggcatcgttatattggtacttgccccataagaatatgtataaggttcctgattattctccggacggagtttattacgttctgctgtataattgattgaaccattcaacgaaaactcgaaccagtcattacgataagagcctgtaaccctctcgcccaacatcaaaccggtacttgtatttctatcattgtttttcgtatcctgattgtagaggaacgctacattattctgataattgatgttggtaaaagtattaatcgtatacttcttgttcctcaaagctgtattgaaaccgaacaaaccaaaagcattccagttaccgttaatattttccggacgcgtaatcaaaccaccggtttcttcattataacgagtactattgctgatactgttctgtgtagcagtaaagctgaaatgggtcataattccacgctgtttctctgcattgtatgtattgtagaataaacgcatcgtatgtgcaaaagaaggtttcaacccgggattacccatacggatattcaatgggtttgagttgtcggttataggcaacagattctccatagtaggttgactgctacgtccccggtaggtaaagcgcaactgactcacctttgagaaacggaagcgtaaatccatattcggtgcaaagttaaacacagtacgtgtcgtatcgatcatatagtctccctttttataggacaaagtggaattctgcggctggaaagacatacctacattcaactgatacttctgacgaatgaagcgtaaacccactgaagcatcatggttatagtaacgatattcggcattcttactcaagctgtccactgcatgagcttcgtatccggaaggaagggtccccccgatagtccaatcgggataatccagtaaatcgaatgtagtcttgtcacttttactgtatttgtactggaactggtagctgaattgtaagaaagtagcctttgcaatcggttcgctataagtcacttgtgccgtatagttataattgtgtgtaggagttgtaatatactgattacgatacaagatggagtcaccccccaaatgattcaacaattggtaataacgtgtttcggattgcgtatattggtcgttatcattatcgccataaccgaaaaccccacggaaagtcaggttacgtcctttattattcaatttccggttaacctgcaaagtggcatttcccgacagactattccccttggacagcgaagcactgttggtagcatttacacggatatctttcagcggatcatcggaaagattgtcaaaattcagataatcattcggatttgccaccagattgaaaggatcttcattaaaggttcccgactccgaaagagaagcattgttggttcttccataagaaaaattcgggcgaaaaataatatttgtcagcgtatccggtttccactccatacggaagtcggcattcacatttgtccccttattccggttcttattattcgaattagaatatgaattaccattctgaaggaagcgttcggaagagttgatactcgaaatatctccatcctggaaattataacgtacactacctcccagttcaatcttgttggtctgagtggcaaaggtagctcctaacattttagtggcattcaagccattgttgctccgccagcgcggccctccacctccaccggagaaaccctgatcgtttacattgtttgccgaaccaataatcgaaaactgagtattatcaataaagcgattcaacatcattcgtccggtataacggtccttagtaccggctcccagatctgcattgccaaaccatccttgattcattcctttcttcacggtcaggtcaagcaccgtttcctcttcgccatcgtcaatacccgtcacacgtgccaaatctgattttttatcataagttttcagcttatcgaccatgtctacaggaagattctttaaaccggtttttacgtctccaccaaagaattccttaccgtcgaccataatttttttcagttctttcccattgattttgacattaccatcatcatctatttcagcacccggaagcttcttaaccaactcctccaacatagcaccctcaggcgtacgataagcactggaattatacatcaacgtatcttctactaccgtcacctgcggagcttcggccaccacaactgcttctttaagcataacagcatcggttgccaattcgatatttcccatctttttggcaggaacattagccgttaactgaacggggataacttttgtgatgtatccgataaaagatactttaagcagatattttcccggtttctgcttggataaagagaagtagccttgtgctgaagtggtcatacccgctacctgagcactgtcggggagagataataactgcacggcagcgagttcgaccggttctttcgtaccggcctctattacacgtcccgatacggttacaattttgttttgcgcataagtggatagggtaactgtcagcagcaacaccatccagatcaatagtttcttcatttgcctgtaggttgaataataacaatcgtttgtttgacaacctttaaggcaaaaggtttaatttaaacacgattatcttttaaagattttatcgacttgtgcctttttcataccaaactcaagacagagcacattgataatgaggaaaataagaaaggaagaagtatcaactgtcatgatatctcccgttgccacccgataaagcatccccccaaataaaaaaagtactgtcaaaaagatggcgttacgagtcgccttgttccgtataatctccgtttcacgcccttcattacgcgataaagcaaagagaatcatcactgctcccaacatcatcagcagcttggtgcattccttatagaataacaagttactgtctgtcaccattccttgcatcactaacaggaacggaatgaataacgatacaaaaagaatcacatatcctaacggacggcagaatacaggtaataatgctttcattttatctaaaattaatgtcacaaagatagctttttctcataaacgaaactctatgttttacatttttaagtgctaagtttcactatttatctccgaacccctatctttgcagtatataaaaaaacatcgaaccattatgagtaaacaagaagtcattctttgcgaaaatctggaaagcagtataggacgtgccgtcgaaaactgcccacacgaccgcctgttcattctcaccgacgatcatactcaccgtctctgtctgtcacaactgataaatctgccgttcctgaaggatgcggttgaaatcactatcggagccgaagacgttcataaaacacttgaaacactggcctccgtttggcaagtgttaagtgaaaaaggtgctacccgccactcactccttatcaatctcggaggtggaatggtgactgacttaggcggatttgccgctgccacattcaaacgcggcatcgcttacatcaatattcccactaccctgctggcgatggtagacgcttctgtaggcggaaagaccggaatcaattttaacgggttgaaaaacgagataggtgcctttgcaccggcatccagtgtattaatcgaaacagagttcctccgtacactcgatgcacacaatttcttttccggctatgccgaaatgctgaaacacggactgatcagtaacactgctcactgggcggaactactcgcattcgatacggaaaagatggactatcgatacctgaaagagttggtgggacgttccatacaagtaaaagaagacatagtagagcaagacccgtttgaacacggtatccgcaaagcgttgaatttgggacataccgtaggacatgcttttgaaagcctggctcttgccgagaaccgtccggtcctccacgggtacgccgtagcctggggaattgtttgcgaactctatctgtcacatttaaaaaccggttttccgaaagacaagatgcgtcagaccatccaattcataaaagataattatggcgctttcacgttcgactgcaaacaatacgaacgcctatacggattcatgcagcatgataagaaaaacaatgcaggtgtcataaacttcacgcttctgaaagaaatcggcgatatcagtatcaaccagacaacggacaaagatactattttcgaaatgttcgacttctaccgggagtgcatgggtatgtaaagcaggcatcgtgacagaggtatccacttccgatcatgaataaatgaagtaccacataagaagcataagacgaatcggcaggttgcgaaaatcacaactaatacgaatgaccacccgcctttacaatcccaaggggtatcaggaaatattagcataatgcattattaactaatcatttaaatggatagtgatctgttccccaaacctttgttttaacacaatgttaaaacaaaggtttggggaataaaagacttgttctctaacgtcaagaaacaaatcttttgcaaagaagagttttattatctcatattcagattaacaatgttaatggatcgtttcacccaaagactttactctctgagcatgaaaaatgctataaaggagaaataaatcatccgaatattttgcttattaaaaataaaattctacttttgcactcgcaattcgggatgtagctcagcccggtagagtacgcgtctgggggtattgaaatgagccttaataaatagaaatgtaaattactaaatataaaggagttaagctatttcctaactccttttttattacctgcgaataaatttcgattaaagttttcgggaaacttagtacaaataaaggtaaattgcggactaattgcaatatataaaaccttttgcgctcctcttgtttttatcacaataaatattgtactacagacctccaatttggaaaccgctctgaaccgaactgtattagctcacctttaaaatctgccgcaccgttctttttcctgtcatctattaaatagtcacccgcatttaagtttttatgatgcgataatattaaacgtttatagcacacttcacccaaatagcgtttcacccattctaacttgtcagaccatgcacttgggttatcccatggagctgttgataaaatataaatgtcatatttatcctttaaacggttcatagcatctattgccccttcattgggttgcatttttgcaaatatattagaaccacatcataaaaccctacatatcaaccttttaatccctcatctaaagcgtctatgcccgactggaaatttaccaatacattatccatatctacatataaaactttcttatttgagtgctgttcgaggtagtccaatgcttttttataggtttcctttttccaatgtagcttactacccaagcgggacaaatccatattatcttttaaatcctgtattttaacttttacagcaagtggattggttgctacacgctggataaacgcttggtagtcctcaccctttattttagttaggcatttcaaagcagccaacacgtcatcgctaaaactttgtgcttttaattcttccaatgttataagagtatcttccaccacatcgtgcaataatgccacaatcttttcatcttctgtttgacagcgtaatgccactcttacaggatgaagtatgtaaggatcaccagccttgtctgtctactcccaatgagccctataggcaatgtttaaagccttgttcaacataattcctttagattaatctactggtttaccgtcacgcaaccattcgttcgccatgcaggtaatctccatatcctctgcatcagcatcgtttggtaggtcgtaacccattgttttccgtttttcgggggaagcggcttggtacatccgtttaaacgccttgtcgctttcgtaaatttccagtttgtaggacttttcaatgttgtctttctttgccatggtaattgcattgattatacataaacttgctaaattaaatccttcatatctacacagatgaagtatcaacacaaactaattatgacaaatataattaaaaatattccatttatatcgtttttatgattaatatttgatatcttcgtcgaaaataaaagctaaataacaatatttactcttaataccgacaaatatggaaactactgattacaaactgtacagttataaaatgaagaacgacaaccgttttgcccctaaccctttatttggagtgctgacacttgccacatgcaaaccatatatgaggcttaacacaaaagtaggggaatggattgcggggtggacgtctgcacacattgcacattcgcctacagaacagggaaaggagaaacttgtatatttagccaaagcaacccgtaaacttacttttgagaaatattgggaacaatacccgcaaaaacaggctgtttataccgaggacaaaaatgtaccggaacgttatggagataatatttaccaacccgaagtttctgcggaggacggatttatacaaatacaaaatgttcatcatggcgcagacaagaaagcaaaggacttgaaaggtaaatacgtccttgtctgcgaggagttctattatttcagttgtttatcgccccttgaaatcccctcttacctgcgtcccaatgtacctaaaatgcagacacgctacggaatgattaccgaggacgcttccgcatttgtcaattatgtaagactgcataccaatcaatgcaaatatactgatgcaaaatgaaagttatactaagtagaaagggatttgactcccaatatggcggaatgcccagtccaatattgccggacgggacgttattatcattgccaataccctcaaaagaggatactacaaaatatacagatttgacgtggaacggcaaatcatattacgaattaatacaggaattgaaaccaagcagccaaataaaggcaaattatacctgtcatttagacccggacattaggaaagcagcagcagacaggcttgacggttggaaacttacattcggacaaacaggttttcctttggggcatctacagaaacaaaaagttggtattggggacttgtttctgttttttggctctttccgccaaacagagtttatagacggaaaattaagttatgtaaaaggtgcatctgccttgcacgtcatttacggatatttacaggtaggggatattgtctgttcacaggacagtgtacctcactggttgacagaacatccacatgccaagacagaacggtggaaacaacccaatgcaatttttatcgcctccgatttactgtcgctctgccccgaacagcccggagcgggatgtctttcttatgctgacaaattagtgcttaccaagcaggggtgtagtaaaagcgtttgggatttacccgatttctttagggacatacccattacttacaatgccaatgcttggaaagatgactgttttgtatcaacagccaaagggcaggaatttgtgtttgaagcaaatagtgaagcggtagagtggataaagcacctactattacaatagctgttaggcattttattttgacctcctacgataataatagacatgaaagcgaaaagacaaacagccccgaagaagttaagaggcgtcagcaaatatttgatgaatacggaaaagaaaagccgaagtgatgaagactttggcttgacttcggctgccacacctaaatttccctttttcctattaagatgcccgtggggctggcagttaaaatggtagcggttctggaaagtctattacccattaaccttttgacggtacaaatataactaaaattcagcatactacaaacttttttaggggtatcgtggaacatatttactcatttattgatagttcacaagattttaaggaggagactccaatgaaacttttatctatttgagcgtctaaacttttacaaacgcacttgaacaacctcatcatcgtagttataaccacaaacacactttacttattgattacattacactcatttttaggtactgcatgacatttttgccccctacattgcaagtcctctatgacgtaataccctgtcattacataagtttatcatcatacagtgataatttgcgagtgctacatcctctttacttaggcacctgcattgactctatcgaccgaacacaaccgccttatcacataaaattaagcaacctcgtattagagcgtttaagccattgttataccctaccgaatacttttattgtatttgataagtttttggctgtaccgtgccaatagagggcttgttttagggattaggagtgaagctgcctattggactgcgtgaaacaggtgctgttcctcactgacacttaaaccgtctgccgactcttccaagagccatgtaagatactgttccattttattgataagttcggatatggaatcggaggctggaagatggatttcaccccagtttaatgcctgacgaattttcttttgtatgttatagtggaggcggttcttgccgtcatttttcgatgccctgtttttaaataggatgtatttcatataataagccatattttgtcctccattggctacacaaatgcaccagtttacaaagtcggcaaccgtcttaaaatcgtcaaatttaacgtccaaataccctttgggcagtttttccacgctctcaaaatagcaaaaccactccgtaacaaacgtccaaaacacacgcttgctataaagttctccggctgtcagtccgtccttaaacagctctttcagtcttttctccttaaacgtcacctcataccttaacaggttctcaggtaatccagtcctatcctgtggcagttcacgcttcttcttggcttcctttatcttgtcgtaaaacttaatcttctcaagcatagtttccatatatacggtttcaccaatcttcgacactttaaactttctcattccacccagtttctgcaaataattcatagggggctggctcatctcaaaattatgtgcaaactccagctctttcacaacagcatactgcatcggcactcctaatatatcactcaacctcttaacaaactgttccacctcatccaaactcaatgtgtatatgttgtgtccgttcataaacttaggtatgctacccataaataacacacctctcctgcttatatctatcctgcccacatgtctgccagtccaataatatccctcatcattgtctttagtcgagcccttaccaagtaaagtccagttcgacctcaaacgctcaactacctcatgccagtcataaccatctatatatgcagcgtccaataccaattctaccttgtcatacatatcattaaattgttaaatcgtttataaatgggttataaaaatattcgtaatattctgtataaacagagttttattatagaagtaagtttttagagttccgcatccgtgcggcaagctgtccgtccatacgttctataaattctttgtccgtttcctgtttcctttccagcacccactctataatatctttgcatttgaacatcaacttcctgccattgtttcctgcacggtaacagggtatcttattcttggctgtcagtttataaatggtgtcctttgaataacctgtcaactggcagcaaatatccataccaaacacatccgggtaatcttctatcctttttaggggtctgttggtcttctgttgtccgacctgtggtttggctgggtatgtaccccgcatttcttttgtaatatccctaagactccttatctgctccaatacggcatcttcccattgtgaacgtagaaactccaagtcgttaaagctccatgctgtttctatgtccgtgcggtgcagttcattgatgaaaccgtacttttctatccccctgtagaggaaatctgcggtcagttcgattttaccttcgtcattgtgcagcttgtccgccatgcacaaatcctctatatctgcgctgctcatattggggcgtatgcgcctgcattcaggtataaaatacctgtctctccattcatttatagctttgtctattgcatccactacctgttgcagcctttccttgtttccgtaacacaatgactggatataaatggtttgacgtgtaggagtaaaaatgtttattcttctttgcaacagtcttttaattgtttcgtccaatggtgttgcatttcctatatagttgattttagcttccatattcttgttgtttatattataaatgcttgttgttatagaaccctcgcagcactgtcaagcacttcggtcttgaagctgtcaaggtagacattcgttgtggtaaggttcttgtgccccaatgcttggctgataacttcacggggcatattgttttcctgcaaggtcatagccattgaatgacgggatacataggtggtaagaggcaagtggatacccagtcctttccccaatttcttcatgttcatattgatgcgcttgtaacgggtacgcacatggtcgtaaagttccaccccgtcatagtttttggtaatgataggcaacaggtaatcccccataggcggaatgttggacttgaaccattccaacagttcgtttatttcatttatcacaggtatctgtataggcttcgtgtttttggcgtttttaatcttctgccgtttataaacgatgtgcaagcctgtggaaagcataactatgttttggcttgtcagatgtgccatatcaacaaagttcattccgaagcagtaataggaaaacaaaaacaaccttcttgcacgctccagtaccatattttgctggggtgtgttttttatcagtgccagttctttaggtggcaggtaacgtttttctgtttcttccgccaattttccgacttcaaagcctccttttccaaatgggtaagtagcggatgaggcttctttctccttgatagccttgtttattacagcacgcaacgtctttaaggtgtgcatccgtgtgtttccgcagcacccgttcaattccatagcgtggttcaaacggtttatgtaccttacgtcaatgtcggaaaactgccgttgtttggctttactgtcatagaggcaaaacaagtgcaggtcgcgtgcatatactttggcattgcctatatgtcccgtagccataaggtcatcgacaagcctcctccaaaagtcatacacctttccacgctttgaagcccctacaaattcttcctcgaagcgttctatcgtccactccgtccgttcctgtgcgaacttgcgcagaattccgtctttccgttcctcgtagtggttcaatagggcattgtagttttcatagttggagaccacacgtctgttctttttaaaccgttccgtctctgcgttccactgttcaactgttgcggaaagtccgaggtcaatgtatttcaacctaccattttgggtaatccgtaggcatacggggcatgtgccgtccctgcgaatattgcttttgtttaatacaatttttacttttgccattgcttacttttttttaaaaccagtgtataacgatgaaactcaaacggagagttacgaaaaactgcaataaagctatatatttagatttatttaacaatgaaagacggactacaattccgaaatttcatcggatatacctttttagccttgctccaactttggcagtattaggaaacttccacttccaacagcgaataaatttcgattaaagtttgattaaagtttttgggtaacttaaggctaataaatacaaggttcggaggcagtgtaagggcaactaaatgcaaaatgtgttatatggacgggatacactttattcttgccttgttttttatagttataaaagtgtcaatacaatgcactatattacaatactttataaatttaaaagaaataaaccatccgaatattttgcttattaaaaataaaattctacttttgcactcgcaattcgggatgtagctcagcccggtagagtacgcgtctggggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcactcgcaattcgggatgtagctcagcccggtagagtacgcgtctggggggcgtgtggtcgcaagttcgaatcttgtcatcccgacgaattgaatgaaataaggagttaagaatcaaacttaactccttttctttttatctgatagtttgattcccattttcaccgttacaacacctacactgcaaatagagaaaaagcagaacgttgaatattcaatgcaattcccctgattatttccacatgttactcagtatctcaagtttttttctatctttgccccaaataaaacagcatccggaaaataaacggggtatgtccactataaatggatacttcgcataaaaacacaaaataaaaatcgtcttattaacaagaaaactcaaacaaaaatgaaacgcattgtttttttagattatgtacgcgtattcgcgtgcttcctcgttatgatcgtacacgccagtgaaaatttctacggtgccgccggatccacagatatggccggaccacagtcttatctacccagtgaagcagaccggctatgggtagctgtctacgatggcttttcacgcatggccgtgccgctgttcatgattgtctcagcctttcttcttgcgccgatgaaagaaggacagaccacatggcaattctaccgccaacgcttcatccgcatcgtaccaccatttttcatcttcatgatactatacagtaccctgccaatgttatgggggcagctaaatgaagaaacctccttaaaagatctgtcacggatattcctgaacttcccgacactggccggacacctgtggttcatgtaccctctgatcagcctttacttattcatacccataatatcgccatggctgaaaaaagccacggcaaaagaagaacgtttcttcatcgggttgttcttattatcaacatgtataccctatctaaaccgttggtgcggtgaagtatggggacaatgtttttggaacgaataccacatgttgtggtacttctcaggttacttgggatatcttgtactggcacattacatacatgtccatctcacttggaaccgttccaaacgtctcactgtaggaattatttcaatggtcgccggagcaatattaaccatctactctttctatgtccaagccatacccggagaaattctccctacacccgaaatagaaataggatgggctttctgcacaatcaactgtgtacttctcacagcgggtacattccttctttttacatgtataaacagtcaaaaagccccacggctcattacagaaatatcgaaactcagctatggcatgtatcttatgcacatattctggctcgggttatgggctacagtgttcaaacatacactggcacttcctactgtcgctgccataccatgtatcgctgtcagtacattcatctgctgcttcgtaactgcaaagatcatctcattcatcccgggcagtaaatggataataggataaatatccgctatgggaactgttataaaatggaatattgcaaataccataggatactgaatcagataactaataatcagagacatacgttcctctgaatcagatcagatttttaatgtagaaacaaataatagtgagcccctgtccagtatattccggacaggggctcaactctgaatatataaagataaaaagtataaatgcccctatcgtttaacagccctcaattcgtgcttgatataacgacgtatcacccggtatctgggatgcaaggcatggagcggacgaacagaattatgactgatccaaaacagcatcaggcaaaacagactgatcagcgtaagccatccgtacagctctttcatggaaaccatcagggcctgttgttgtaagatgccggatagttgccctaaagggatgtggcttgcctgtggatgaactgcatccagtgcactgcccagcaacatcgtattcttcttcatcaccacactcaaggctcgctcgagaacggccgcaccgagtgctccaccaaaactggcactgacaaacgcctggacagacaccgcttcaaaaaagttctgaaacggcacacgtgaaagtgctgtaataaaacaaatggcaatgatcacatatccgaaactacgcaaaaaaagaggaagcatcaaaacctccttggacaagccgtagtcgatagtaaaataaaacatcatcaaataaccggtgatagcaagaaatgcaatgacggtcatcgtccgataacaccatttacggcgggaaaaggtataaaacgtaaaaacactgcctacaaccgttcccaataataacatccaattgagcgaaatcacattcaaagaatcataaccaagcacagcttccatatagatatgttcaaacaaatgcgaaggtgccaataagatatcgacgacaatgtaaagcagaaatgtgagataaaccgctttaaaccgccaggtagccaacgcaatgaacgggtgacgaatgaaagaagcccgccacaggttcaataacaggactgttattcctcccacggttgccacccgaatgtagactgactcataccaatcgtaatgttcgccatacacacagacaaagattatgcataaaatcacaatcccccacatcaaagcgcccagccagtcaatgccgaagagtggtaactttggcatcgaacggtaattgcggaacagaatcatagtcgctatcatcacaagcagcaataaagcaataatcaaccaatgcatatattcccatttaatccagaaagcagtataaacggttatcagtcctgacagttgaagacagccctgcaccaacagatagatataacagaagaagacagaaagatctctctgaggggtaagccaaagctggatggtagagttacattcaaaggtagcccacatcctgaaaattccaccaaagaaacaaaccgtcaccaatagcggcacactgcgggtatacatacatatcagattacacaaaataatggcaataccacatgtcaggaaagtggttttcgaaggaaaacggaacttcagacggaacataatggcaaacgtcagcgacatccctaccagagaagcataacccgccatcataatatcttcctgcatcaatgccgtcgagccgaccatctcactgactgcggccagatagacacctccggagaactggaagatgataacaaagaggattacaatccacggcctcagcttctccggtacaaaatcacgcattgccggaatggcaaaaggagttatttcatgcatactttaatagtttaccacacattccacattcattccggcacgcagacgcttcatgtcttcgggtttgtttccgtccgaaaactcgatacgtacgggaatacgctgctctaccttcacaaaattgcctgcagaattatcctgcggaagaagagagaaacttgcccccgttgcctgcgaaacagattttaccacccctttaaacactactccgggaatagcatctacttcaatatcgaccggataaccttcaccaatatgggttgtttgggtttccttataattagcaaccacccatttatcgttttcgtctaccagattgaccaatgtttgtccgggctgtaccaatacaccttcctggatctcttttcgtccggtagttccgtcgcaaggagccgtaatcactgtatacgaaaggtttaacctggctatttccagagctgcttctgccagttttatgccggcttcggtctgttccaggcgttccgtctgctcctgcttgacgagtgctgtcgactttttctgacgaagtaacagttcgtaacgtgctttcgatgcttcaaaatttgttttcaccgcatcgtattgctgacgggtaacggcatcccgttccaacaagttctgataacgtttatattcgcgtccggcattatccatacgtattttagcctcctgaatgctggcatcggatacggaaatattgttctggatggtatggatggacgaagtcatcacggtcttacccgataaggcattctgataatcagcctctgcctgtgccagtctgaaacggaactcggcatcttctatcaaggccagtgtatcacctttatgcaccgtctgatactccgtaaaatagattttcctgatgaaaccctgtacccggcagttgacgggtacgatgtgttgacgcacctgcgcattgtccgtaaactccacatttccccaatggataaaacgggagcagacccaaccgagggccagaagcaacacgataataacagagatattaaacgccagttttttagttttcttattcataacgattgattttagatagttccggagatatacagaagtttataataattaaatacaatattgatctgtgcatttaccagttgcacctcggcagcaagttttgagttactggcatccagcatatcggtgatcagtgccatatcatttttataacggtcacggataacggcatagttcagattggcgagttccacacttttccgctgggtattcagttccacataagtttccagatatttcacctgtcctgcattgacggccagttcggtttgctctttggcatcttcatactgctctgtactccgccggatggcaaacttatcccgggcaacggccttgtcagccttaaacagagaagagaaattatacttcaaccccactcctacataccaatagttaaggttcttattgatgggaggaacttcgatggtaataggtccatccagtttgttaccggcaaacagagcaaccttcgggatccgctccgatcgggtaatcttctgctgatgcctgctcatttggactgcaagcgacatctgtttcaatacgggagagttcgcgtaagcggcagtagtccagttctctttagcttcaacaggcagagctttcgaaagaatggtagtgtccggctgtatactgacattttccggcagccccaggctggtggtcaaattgttattcaggatggagattgtattttcaatctgtgtacgggtcaattccagattggccaacaacaactcgtatcgggtgatgtcgtttttcagaacgactccttcagcctccttcgcgtggagttccccgatgacctgtttagtctgttcaatgttcttctcatatacctgtaacatgttctgttgtttgaacaggtcgagataatacccaatcagcagaaagcgcaccttatcgcggcttgtatccagattcagacgggccatctcttcctgcaaacgggcaatggcaatactattcgtgatggctcctcccgcatataccacttgcgtggcttctattgcaaaattattgccataatgcggcattgacgcattggaaccattcgaaaaattacggtctgtcagcaatgcatctcccagatagctgaatgacaaagaggcctcaatctcgggcagacgggcatttttagcaaccctcacgccttcgtgtgcttcactgataccggttgcgcacggacgcaacgatttactgttctggtcggcaagcgaaaacatctcttcaatggacatggtttgtcgtgccgcttcctgagcatacacgctcaagggacataatgacgcatagaacatcattatgaacaaagtgaatttgttcatacgttgttacttatgaattttaagaaataataaaatgtaaagaggaaaaatcaggtaaagggacttacctaatccgaattttctcttccccactgatggaagagtgcaagtttggttagtataccttgaaaggactcaaaacggggctttctgtgtttctgtttcattcgtctcgtggaactttatgctccatccgggggacaaagttacaaaaaaacaagattcagtcggcaacggaagaggttatttttttcatacagcctctccgaaaaccaagagagggagccaggcacgcagccaaactccctctctttattcagattaatgtcttatttcttatagactttcagattcgtaatcttgctatcaaacttcccggctttctctaatgggaaaaccaaagtacggacataattcatagaatcctttccggcattatagtaaagtttctgagtattcatttcctctaccacctgaccgttgataagtaaacgggtcgacttattgtcaccactgataccgatggttgctttctcacctttgtggatacggtgactaaatgtattcaaataaccgtcacgggcaaaacctaacataccacgaatcggatcggagagatagaatacggcatcgggcgaacggaacagttctgtaccctttgcttcgtcggctccgtcaatatcgaatgtcaccagatagtcgtatccgatttcgcgatggggtgtcttgctgcccggggcaacagaggcctgctcgtataccaaccccggtgctgtaccgatacgcccgagttggttcacacccggagcctcactgatggcattacgttgtttgtcgaagtcggcataaggaacagacgtatcttttcctgtccacatcttcacagccaaagtctgcaaagccggataaacgcggtggtgaatatcttttgtcgagataccgttgcctacatggtcgttccatacggcaaacataccacccaggacagaaggatctttctccgggaaaactgctttgccgatgtgtacaggggtccagttctcatacagatacttcgtgttcaggtagtcataatagtatccggcagccggaacgatgtataccagcccatcaggaatactgatcaacttatatccctgttcgatcatatctttcggattggcatagccattgtaccaggcactcatgatcacattctccgatttcaccggtgtatcacctttggcatgtgtcagcgctccccatacgcaagcctgtttgccaaaactctctacataacggatatagtggtcggtgaaagcacggaacttctctaccacatctttctttttattagaatattcgtcagtaccgatatgcactttctttccacggaataccggttcgtctccttccagatactccttaaagagaccatccataaacttataagtttcaggattgaacaagtcgaggtgatccatgccatattctttgctgccgatctccggtttataatgtgtaaaggcaagagtatgtgccggagcatcgatctcgggaatgatctctacataaagattctcggccagcttttgcaagtcgataaattcacgtttggtgtaatatccgtcttcggcagtcagtccgggatacgtatccgactccagacggaacgcagcataagtcttcgaccaatcatgttcaaagtactgtttaaagccattatcattcaggtgaatctgcaaagtattcatcttgtaataagccatgatcttcacatagtcctgaaggaaagcaagaggaataaacttacgtccgcagtctatcatgaagccacgcacggcatagtcgggaaaatcgcgcaaagttcctttcgggaactggtggttttcactttgttccgcaatctggagcaaagtacgggttccccaatatacgcctatgctttcgggagcagtcagcaagatccggtcggttacttttaccgtataaccttctttacccaactttttatctgcgcggatggcaaggatcacgtcgccggctccgcctttgccctgtaccacttcgggtttatagccgaacattgtttcacaatcatcggccagcatacgggctatgcgcaacagttccggctgattggcgggacagacaatctttgtagcttcggtaggcacaaacgctccttcggcacctttccactctttcagttcgggaatcacaaaaggtttgggattaacaactgcactgatgccgggacaaaccaggcataatgccacaagaatcataaagaatcggttaacaagtttcatatcgtgtcgttataaaagggttaattcaaccggacatccgattgcggaaccaaaagtaatgtaaatctatcgattgtacaacattctgttcaaaataaaagaaagttggcaccccggcagacaaaattacatatccgctgaagtgccaacgcggggtctttgtttccgctgaaacggtgacctcatcacaaacaaaacaaacatcaagctgatggcaaacaccaacttgctacagaagtccttttcagggaacctcacggcctctcatccgtagatcttaaataagtttaccggacaaatcggggagagtaaaccagaaagtcgatccttctcctacctttgaatctaccccaattgttccgtgcaatcggtcgacaatgattttgcaaaggggcaatccgagtcccagcccctgcacaaagtcgtcaagtttcacaaaacgttcaaatataagttcctttttctcttcgggaataccacatccggtatccgtcacgtaaaaccagatccggccttcctctttcttccgataacctaaacggaccgttcctttcaacgtgaactttatggcgttacacagcaaatgctccaatatctgtatcaaccggccccggtctgtgtaaatatgcgccccaagttgctctccgtcccaagccaggacgaggctacgtgattccgccttgggcctgtatatctgttcaatctcctccatcaacgggtcaaggagaacatccgaaccggccatatccatcacacccgactcaatgttagagaggtcgatcacatcgttcatcagccgcaaaagatgttccgtattgctttgtatcaagccgatatattcctgctgctccttctcatcgtccacaatggaaagaagggatgcaaaaccgacaatcgcattcaagggggtacgtatctcgtggttcatgttggcaatcaatgccgacttcagccggtttgcttcttccgccctttccttggcggctgtcagctcttcttccaaggccttccgtttggaaatcgacatcagcgaaccttctaccgtcaacaacttgccattcccgtcgtacttaccggggatggcatgcatctccaaccactccaacaccagtccttctttctttttggcccagaaacgaagttcgataactactttcttgactttgccattcagcaattcgcgacaggccctgaccacacggaagcgatcttccttgtatatgccctcgtaaacacgcgtaatagaaaccgggaacaagtcattatgaataatctcccacccttcgggatcgtccgacggacgggcatcaaaccagaccatacgttccgccagttcccatttccatgggaaaacctctgcaactccaagtgtcatcagcagcttgcggttcacttcattcagcatctgctgagtccgcaacagttcggtttgttctttttgtttcatctatgcgttatttattgatacatacgatattctgtgagtgtcatcccggtatgcttcctgaaaaaacgtcccaatgacgactgattcgcaaaatttgtcttgatggatatctcctgtatattcatggtagagttcttcaacatggctttgatctctaaaatggtatactctacaatccagtctttcgccgtctttccgcttgcttcttttatcaccatcgacagatatttggaggtgatacacaatttgtcggcataaaaggcgacatctttatgttctctgtaatgctgcattatcaaacaaaaaaaatcatgcgccaacttgctcttacccaagtccgactctccctttgccagatgagatttgccataataatcattgtagatatccagataaaaaatccttaataatagaagcacggactctctcctgaaaaagtgggtaggatctttggcccgttctgaaagcgattcataaaaacgcttgaaccgtccggcctcttctccggtcagttcgtaccagtaatggctcctcatataaacatagaaaagaggagaaaagcgactgaacccactcaacgtatcatcaaagagtgcacgggaaagcacgactatatcacaaagaaaatcactgctcaactcggttatcgaaaccaattgcccgggcagaataactgccagctcgttcttcgtaagaatgtggatattgtcaaagatacaaaccttggcggtccctctcaaacataaaataatcattccggcttcagtgtaggaaggagcagaagtcacacgaatgtgcttcatattctcacaaaccataagttcatcccccaataaagtcgtggcataactatctgttatcaatttctcactatccctgtttggcatcagaattctttcattgttgatacaaaagtaaaataactatgctaaccccgttaccgcacaagacttttggtatcataatacggaaatatgggggctcttcttgacatttttttataaacaaaatgtctataagcctataaacaacctattccgtatctgtttgttcgccctgttaatgtatattggattccgttcatatctttaatattttaagaaagggatagggacggaaaagaatagatttcctatttttgcaaccaaatataactatagcaacaaagatcatgcgttatctactctcagcgccttcgcacataaaggccaccatccagcttccggcgtcaaaaagtatcagcaaccgtgcgcttatcatccatgcactgtcgaagggcaatgacgtgctttcgaacttgtccgactgtgacgacacgaaggtcatggtcaaggctctgacagagggcggggaagtaatcgacatccttgccgccggaacggccatgcgcttcctgacagcctatctgagcagtacgccgggcactcacatcatcaccggaacggaacggatgcagcagcgtcccatacagatattggtgaacgccttacgggaactgggagccaatatcgaatatacccgcaacgagggtttcccgcccctgcggattgaaggggcaccgctggccggcaacgaaattacactgaagggcaacgtgagttcacaatacatttcggccttgctgatgatcgggccgatcctgaaaaacggtttgcagctccggctgacgggtgaggtcatctcgcgcccgtatatcaacctgaccctgcaactgatgaaggacttcggtgcatcggcccggtggacatcggaccaaagcatctcggtcgagccacagccttaccgctgcgtcccgtttactgtagagagcgactggagcgcggcctcttactggtatcagatggctgtcttgtcttccgaagcggatattgaactgaccggactgttccgccacagctatcagggggacagccggggagcggaggtatttgctaggctgggaatagaaaccgaatatacggaagaaggcatacggctgaggaaaaacggcagctgtgtcaaacggctggatgaagatttcgtcgacatcccggatctggcgcagacgtttgtggtcacttgtgcattactggatgtccctttccggttcaccgggttgcaaagcctcaaaatcaaagagacagaccgcatcgaagctcttaaagcggaaatgaagaaactggggtatgtgttacacgacgaggacgacagcattctgtactggaacggcgaacgcatagagccgcaggcatgtcccgtcataaagacgtatgaagatcaccgcatggccatggcttttgccccggcagcgattcattatccgacaatacagatcgatgagccgcaggtcgtatccaagtcatatcccggatattgggacgatttgcgcaaagccggttttgtgatcgaggcacatgccacagaaacaagcagcagacagtaaggtttagattatcttataaaaacagatcatccaatcctgtttctcctaccctccggacgacagacacagaaagctgaatacaaagacgtctccagccccatcacagaacacctcccaaggtcgattccgggaaaaagcaaaccctgcctccgcaaagttccgacttcgggaggcagggtgcaataactttaagaataatcaacatcaggagctgcagagcggtttcctttgcagccggaccgatgttcatcatctcaacggctccatccggaaggaatagctgtagaccgtatctttccgtatctcataatggggacggggtccgggtccgcaactggcgttgcccaatccccgctgaatgcagtccagattgagaacaacctccgcacggcgaatgtccggcaaatcgtgcccatacttcacttgccacagatctttgtccgtatagtgctgggcactgaagtcaaccgtatccgttgcggtgattttgagtcctttgccccggtcgtcggtcagtgacagccaacgggtatccgtgcgtccgcccattgtctgcgcacgcgcataatgttccgccatatccgtgacagtcgtttggtaacgcccgacataggcggcattcttccggtcacggtaattctccattgggccgcggccataccactcgacttgttccaacgaggggttgaggaacatctgcaaagccagacggggaaggtcaaagttactacctgttgtaaagtcggccgccacatcgactacaccattactgtaaacctgatatctgacggtataaggaacggttactttccctactttcacttctatttccgaaaggatggatgccgactttccgtcctctgccatcttccagtcaaaaccacgcagcgcgatcaccggctgaatccattcacgaggatcattgttaatagaacgataccagttcagtgacggtccttgctgccgatgtatcaggttctgcccgtcatatcggagagcaatcatcatgccggtcttcgaatcaaacgacacttcggttcccggagcacggaaacggatgtactgccgctcttctatcacctgcagaggctctgaaggttccagcatttcggatttgcgtttcctctccttcagcaagaactgctccgttgccactacatgtccggctttagcccatacgcagtcacttttcagtttcacttccaggttaatgtgataatcggcatcttctgtcaagtggcggaggaaagggatatgaatcgtgcggtgctcgcccggcttgccgtcaggcaacccgaactcctcttctgccacaggcaccccgtctttgaggatgacataacgcaggttgaaatgacgcatattcaggaatgaataatgattgcgcaaccccacattgttctctcccacttcttcaaaagtcatatactggtatacctttttcacttcccataacttaggagtaaccctacggtcgggtgtcaccagtccgttacaacaaaagtcattgtcgttgggacgatcaccgaagctgcccccgaaataataacggtccggcgcttctccgggtttgttgatgccctggtccacccagtcccagatgcaacctccgatcatgcgtttagactgattggcaatgtagtcccaatattcttccaggttaccgacggcatttcccatggcatgtgcatactcacatagaaagaaaggtttattgcgcggctcgttgtcctgagctatcatactttcgatggatggatacatccgtgagtccatatcggcaacgtcattcattccttcataatggatgaaccgtgcgtcaatctctctggcagcctgataagcagcctcgaaattgggtccgccacccgattcattccccatcgaccagaagataacggaaggatggttcttgtcccgttccaccatacgtaccacccgatcgacaaaggcacctttccaactttcccgcttggtcagcatcatgttgccatgacattccagatcggcttcgtccatcacgtaaagtccatagtaatcaaacagagcatacatcttcggatcattcggataatgactggtacgaatggtgttcaggttgaaacgcttaaagagaagaatatcctctatcatgctttctacaggcaccgctttaccgaaacggggatgaatatcgtgacgattggcacccttgaacaacaccaatgcatcattgatatacactttattgtcacgtatttcaattttgcggaaaccatattgttgggtagttgcctcgagcaccttgccggaagcatccagcaattccagattcacagtatacagataaggtgtttcggcgctccagagttggggatcacgaatacttgcttttgcaggcagacagatctcttttccggcagacagattaccgaccgcagttgtaaacgtacgcaaagttttgccatcggcatccagcagccctatgcgtacggaggcattcacagcagacttgccatagttcttcacgtctgctttgacacataagtcggccttgtcgaaacggtcactgatgacagaagtaagatgcacgtcgcgcaggcgaagtttcggagtcgccaccagatagacatcccggtggataccgctcaggcggaacatatcctggtcctccagataactgccgtcactccaacgatacacttcgaccgccaatatgtttttacccggcttcacatactgtgtgatgttgaactcggcatcattgttggcaccctggctatacccgactctcttaccattgatccacagatacatagcactgtacactccatcgaagtggataaacacttctttattcttccagtcggccggcagagagaattccctccgataggaacctaccgcattaggctctttctctaccgtatatcctctctgtccctgtataaagggtggattgttgcgtatcggataggtgatattggtatagatgggggtgccgtatcccagcatctcccaattggaaggaaccggaatctctttccacgcagacacgtcatagcccggtttatagaaatccaccggacgttcggaaggttgctttacccaatgaaacttccagtcaccattgagcaacagataacgggaagagtgattgcgtatccaaggacgggtgtacgaaggatcgcccttcatctcttccgtatcggcaaaggggacaaacgtggaacgcccttcttctttgttaacggcaaatatccgttcattctcccagtcattatcactccgggttttaaaagcctcagccaccactttcagattcgatttcacgattttccattgctggcttattttctgcgcatctggtttgagctggtaaaccggctcggccacaaggccggcatccgggaagcccagattataaccactcgctacactggtgaacaaataattcccattgggtaaagccgtgatacgccattgctgattgggattttctttatttgggtcccattggataaccggacactccttgctcccattgccgctattgtcgattcccagttcagtgagcggactgacaatggaatagcagccgttaccgcaaggaatcagattccagacctgcgactctttatggggttcctttttagaaataaatatcttaccacctaaatccagactctcctgattgtccaggacaagcccgttctgggtatggatctcgtagctttgcttcggatcgaactcctgggcacgaaccattcctactgtcgaccacagagcaacgcttaccagaaacagatgtttaaaatttagcatactattgatattaagaaaaggcagggaagaaaaccaagggctgtatccgccaacaaaacgtatgtctgcctgtgtgatacagcccaaacctatattcaacccaactacctattgtttttactgaaataaagccgattgtttgtacactccgaatgtatggatagcaggacaagcaaatccgtcgaggatacgaagacgtacctgtttggcttttaccggttcgaaacgcacgatccatttataccccaccgtctgcttatcggttgcttccggtatcggggtccagttacggccatcattggagtactccacactccacttcgtcgtgcggtgtcccagttcgatcacttcctgaatcatcaggcagtcaaactccgtctgccggggaagggtgaaaacgatgtctgaggtcttggctccgtcccttccggcaaaataagtttccttattgttgtccgtcaggaattccggacggaatttacctccgcgtccgttcgttgctttcaccttggccttagccagcagattgttcccgaaggtttcgtccagcccctgcttcagcaatgcagcatgaagtgaatcggtggggtgaatcagtccgcgacgatcaggtgggaagttgagcaacagcacgctgttatgccctacagaggtacaatagatgtcccaaagctctttgacactcttcacacggctgtcttcttcggcatgataaaaccaactgggacgaatggatacatcagtctcggccgggatataagcatcgccgccttttactccctcgttcagtccttcgtaatttttccactcatctttgatgcagacagagtcggtagtcgcccagcaaggatcaccggctttacccgattcgttccccatccagcgcacatctgcaaaaggatacgagttcttggttccgaaaatgacacagtccggctgcttctcgcgcacaatcttataccaatgcgtatagacgggagtggtcagctcgtctgctccggcaccgtcccaccaggtttcccagacttttccatagtcacccatcagttcttccaactggtggccataatactgcttgtacttctccgtagtataaagcggagaaagatgctcatgccggtcgtgcggtcccaaatagattcctgctttgatgccatactcttcgcaggcatctacaaattcacgtacaacgtctccctttccgtttttccaggcggagttcttcacaccatagtccgtatatttactgggccaaaggcagaagccgtcggcatgtttggcagtgatgatggcactgggaatgcccgccgaccggagggtacgcatccactgtccgcaatcgagagccgtagggttgaagatagctgccggagcacgtccgtcaccttcgtttacatactcctcaaatgtgttgattccgaaatggaagaaagcgatcatctcacggttgtaccactccacctggcgtgcgctgggggttagtccgtaaggttccggagccttctgtgccgatacgggtaccgccacggcagcgattcccgctgctaaaaataaatttcttagattcatgtattcgtctgttttagatgttcgttatcaaaataaattaagttcgctgaccgtcacatgcggtccaccgttcacggccgtaatggtcaccttcagatagcgtccgtctacggcatcgggcaagaaggaccggaactcaccctgtgccgggatatctttaaacttggcggcgactgtccaggtagcgttgtcttcgctcacttccacggtcacctctttcggaccgtcatagccctcttcgcgtgcctggcaggcaaatccctgaatatgggtggttttcttcagatcaatgacaatccagtgaggcggttgggggtgctggttgctccagtcggttccccagaaagtattcagatcgccatccagacaagcctctttcagcccgctgtgcccccagtctccttctttcggctcttcggacgaagcgctcagggcttcccatccggtgcggtcgagcaactccatattgctggcatccatcgatcctctgaagatgaagtagatggtctggcaacagtcatcggcaacagctccctctaccgaagtaatgctcacgggcaacagatactctttgaatgcctcgatattacctttcgcatgaactgtgattacggcttcttcggacttcgatgtcccggccttgaccagtacttctccggtcaggtcatacgcagcttcaggcagcagttcatactcggttccgttcttcgtattgtattcgttcactttgtccggatcggcttgcaggtgcaccacagcatcattgggtaacccatactccgtcagttgcggataagtttcaggagtaacggcaacgttgaaggtctgtacataaggctcgtcttcaatgtaaaaattggctttcacggcagttcccgcgtccggaatataaatggtcaggtcactgtcattgtcactgcatcccactgtgcagcagaatccggcagccagaatggctgccttcaatatattctgtttcatgattcgtttcgttttaagtagttattcccagccgggattattgggtaacaggttcggattcatcgttgtctcgtcgataggcaacggatgaagatagagcttatcgtcccatttacgggtcgatctgtccggataaacaatcagcaggttgtcctcggtcagttcccgggaaaaagaatcgtactgctctttcagcttgtccgatactttcattccgagcatactcttgggtgcttccagcaacttacccgctttccaacgtacaatatcatcccaacggaaaccctcgccgatcagctcgaccgcacgttcgcggcggatctcgtaaagcaatggagaaagttcatagccataatccggccagttcgggtcggtaaagccgacattcactttcaggtgcggcatctctacacgatctctgagttcgttgatggtcaggtccaatacatcttgagtacattcgcccagttcggcctttgcttcggcatagttcagcaacacttcggcataacggaaaataaacacatccagtgtagactgtccgatgttccactgttccggatccgtcgagtgatacttcattacataatatccggtggtacaatatttggtatctatgaccggaagagcattaaactggcgggtgccgtcactcagcaccttgaaaggaagctccggattatcaatagtctggcgcaaacgcggatcgcgctgcatcagttcgtccatcggcatatctgcctcttcgtattccggactgacagcagtgggcagaccgtcggcacacaggtattgctcaaacatggcacggctcaaacctgtatacgactcttccatctggcgggtattgttgtgcatcaacagcttggtaatataaaccctcggcatgatgcactcactattggaagataaatcttcctgtacaaacaggttataatagtccagagtggggttgtcggtcttataaatcgcgtagccgccttcttcaatcacttgttccgcagcctcggcagcttcacggtataactcttcataatcgcccaacccatgatatttgcggaaagacgcctcgtacaggcaagctctcgatttgaaagccagcgcggcatacttgtgcatgttaccgatcttcgtttcattgggtttgggaaggtgttcgatggcaaaatcaagatcttccaggatgtgtgtaaacacgactttccgcgaatcgcgccccttatacagttgctcggagtccatctgcaattctgtttcataccaaggtacatcgccgaaacgcttcactttgtatacatactcccaggcacggaagaaacgaaccacagccaccgaacggtttatctgttcctcgtcaccttgcacgcgtttgtagcggtccataaaatagttgcaggaacggatatttccccagtctccgcttccccatccgccaccggaagtaggaatcgtttcaaggttgaaaatccaggtcttcggtttctcgttcacgtaacagtccgattcgtcatcggcaccggggccttgcgctcccggcaggattccgtaaaagccattggcataaagttcgaggtcctgcacacttgtccagaatttagggtcggagagagaatcctcaggatacaggtccagcaggtcagagcaagaggtgaacataaaagtacatgccactgacgccatcagtaatatcttattctttttcataattgttatcgtattagagggtaatgtttaatccgaatgaaacagacttggtcagcggataggtgctgaggctcactgtttcggggtcgtatatgtcaaacaagtgatcgaacgtcagcaggttttgtccgcttacgtagaaacgtacatggtctatcttccatttgcccagcagtgctttcggcagcgaatatcccaatgtaatggacttcaggcgcagataagcggcattctgaaggtagcgggtctgcgtttcgcggttaccggtcacgttgtcataagtagagcgggggaagtaagcattgcggttatcttccgtccatgaatcgagtgcatgcttgaaaggtacgtgccactcgttgccgaagccccagaactggttacctcccaacactacatcctttttaccgataccctggaagaatacatcaaagtcaaaatcacgccattgcaatccacccttaataccatagctgtaacgcggttcactgttaccgattatcctttggtcacccggatcatcaagcgtattctttcctttatttatcttgccgtcaccgttcaggtctttgtacttcacatcgcccggataccaaccaccgccgtagatttccgactggtcggcatgggcatttacttcttcttgtgactggaaaataccttcggtaaccagcccccagatttcgccccacttcttgccaacatagtgggttgaaagcagattctgcggattgttgaacttcgtgatctctgcctgataatcggacagtacgaagcttacatcataagagaaatccttgtttacgcggtctctccatcccattgaaagttcccatccggttgttctcagatcggccgtattggcttgcggcgcgcctgtacccagcactgcgggaaggggtgtaccgttagtcaccatatcgagtgtcttacgcatgtaccagtcgaaggttccgtaaagacggttgttcagcaatgcccagtccacacctaagtctatctggcgcacggtttcccatgtcaggtacggactgacgatgccgccgggactcacactggctattttctttccgtctaccagatatcccatctcgccattggtacccattgtggctatataaggatagtcgccgccaaccgactgattacccaacgaaccataagaagctctgagcttgagttcgtccacaatcttcttggccggttcgaagaaagcttcgttcgagattctccaggctgccgaaacggacgggaagaatacgaaccgcttgtctttagggaatttggaggaaccgtcataacgtccgttcaactccaaaagataacgttcggcataattgtagttgatgcgggcaaaatatcccatagtagcccaggagtgctggccgcttccattgtacttctctccgtaggcctgtcccagaccggggaggtcattactgataaggttttcacgctcggcattgaaccagcggtaacttttggtttcataattatatcccagcaacagttttatgttgtgtttgcccaaggacttggtgtagtcggtataggcattaaacgtctgataataattatcgtcggtagtaaacttcacacggctcggagtggtatgcggaaatacggttacgatatccggattggcggtatgttccaatatctccttgccatgctgtttctttgagaggatatacatgttataggtataatccacattgatggtccagtctttcaggggagtgattttcagacctccggtcagccaaaggtcattctctttgttcttacgctcgccggagatggactgagtggctaccatattggtccaactgccctgtccggagaagtttccgtccggatggtaaaccggcatcatcggacgaaggtcagcaccgtagaaagcactgttgatctgtgccgtctcgtcactgttattgcttccgtagggagcatcccggaaagtattgttatagacggtttttaaccgaacctgcaaccaattggtgatgtccgaagtcagattcaggttgacattgaaacggcggtacttatcgtcgtaatgtttcagcgttcctccctggtcgaggaagcctaccgatccataataggtggtcttgcccgatcctccgttgagtgacagcgtgtattgctgcatcaaagtatgatccttgatggtttcgtctatccagtcggtgttaccgcaatacagatacttgttgggattggacgggtcgatgaataccggcagattatgcttcgggtcggtataataagcatagatatgatccatgtagttcttatcataatagtcgcctccgccggagttacgattggtcagattatggaaattggcaaatgtccacgaatccatgtactccggtttgcgtgtgggggaattgaccgaccagttggacgagaacgagatctttgctttctcgtctttacccttcttggtcgtaatcagcactacgccataggctgcctgtgttccgtagatagaggcggaagccgcatctttcaataccgaaacactttccacatcggccgggttaatcatattgggatccatctgcacaccgtcgaccaacaccaaggggccggaagagttgatggaggtagtaccacggacattgaatccgtatcctttgcccggtgcaccgttatcggcagaaatattcaggttaccgatcataccctgcaatccctggctgaggttcgtgataggacggctttcgagtgtctccgccgaaacactggctacggctccggtcagattcgctttcttttgcgtaccataacccaccaccactacttcgtccagtgttttggtatcttctttgagggtgatctccagatgggtctttccggtaacggttacaacctgtgtttccatcccgataaaggagatttcaaactgttcaccctgatctgcgtcaatcgagaagttaccttcgatgtcggtaatagttccccgaccgggagcacctttgatctgcacagaagctccgggcagggggaaacctgtgtcatcgagaacacggccggttattttctgtttctgttgtgctgcctgcaccacttcggcaggttctgcattgtagttttgagaagcaaggcaaggttgaagtcccatacccgaaagaaggacaaacatccccgaggcccttacggctctttctactaattttcgttttctcataataataacaagttaaaattaacattaggaatcaagcaaggcgttgctgactctttttatttaaagacgaaagcaaatgtatctctatggtcttaagagagggattaaataagggttaacgaagcaattaacctcgtgtatttcttgttaaccccgcgccacagtgctccagacacagaatcctctaagttaaaatatgcacaaaggtagcataaagagacaccaagctatcagaaagacagtaaaaagcctttttcactgactgtaccctttacagaaaaggagcaaccggaagaaacatgcaggcaaaaccgggcaaatggaggtgaaaagccgggctttttctcctcgatagccttgattgggagtgaaaagagccgggcttttccgaaaaagaagtaagcatttggtcgaaaagaagtaagcattcccggaaaatgcttacttctttttcaaatatctctatatgttttggtcgataacatatattgttacggagacagagggtctacgggaactattttacttctggttggatgactgggagaaggcttcacgaagtatcgaaaggacaggtattccaccattaagcggacaggcggtacgggagggcatcgcttacgtttctctactgattgaaaacaggcagaattactgccggaaagataaacgtaagtattcgataaactccctcgtataatgggtaacgtatgttcataatatcgtttattcatacaaaagtaacatcacatttttagaatgaaagggggagtttatcgaatacttacactcttgcggtacaggtccactttaattttgaactattagacgttccgtttatgttaacgactcctccggaagagggaaggtcaggtttgcttgtatccatggttgtggatacccctgcacctgcctgagataccgctatactggctgagggtttcgttccgtttgccgctgtaacggtaactactgtatttcgtgctacacgtcctgtgtgagcacccgcactgattgtcaaaatgccatctctcttgcctgacatggggcttacattgcaccaacttgcttttgccataatcgtaatttattaaatgatttctactgtttttgattcgctttgtttttactccccgtccggggtattttccaagttccgtaagaactaggatgtcctttacgccctgaaaagagtatgcgaactttgcggcaaccattaaaattacatcgacatgaaacttattatttataacagccggcttgcaaaacgcatgctgtttccggggtattcgacaatcatgttatttggcattatcctgactaaaagaaggaaagaagaatgtccgcctgcattgatccgacatgagcaaatacatcaaaaacagtattttgagtgttttatactccctgttttaccggctatcctgtttactccatggatgctgaccttatgccctttgagtttctatatactttatctggcagagtggttcataagtttcgtacggtatttttggggtcagggaatgacggatccgggcagagccggccatagggcatatatgtcgtcggccatggagatggaggctaaggtaaaagaggtagaagcagggtatctcgaaagaagaaaacactttgcatttatgaggtattacgacaaaatataaatgagatacaacggagaatacctaattataggtaaattaaagtagagttctccatagtttaacttttttaaccaataatagtatgcaggaatgtattaatgaaatacttttgtgcaaaaatatatttattcgccataaaaacacttcgttgtgaaacgcgggagttgcttatattttatagaaaaggagaagaaaaatctccaatctacactaggggatacatatctcttcactaataaatgatccccactcagtgtttaagttaaatttttatatgtatccccgccacttagtgataagaggcggggtttgttttggaaaatcattatccctatttaataacttacttcaatggatatggtagtttccctatagataaaagtcccgttatttatcgaatatacaaggtcatctactgaaatacacaaggtgattttggggaattatgccacaatatgtatagcgattctacactttttctacaatccttttttagtcatattatataataatctatttatcagcatattatacttattataaaactttggcatacaccttgctctttgatagataaagttagttttaattatccatactaaaaatgtaattatgaagaaagtattagtagcattgacaatggttatggggatgggcagcgcagtagcgtttgcacaagaaccggttaagctccccgctatggaacagaatcaacaaacatctcaagacaaattcacaaagattactgtcaaagagcttccgcaagtagtcaagagtactttgtccaaggattacgaaggaactatagttaaagaggctttcgttgctgaaaaagaaaacggaaaggtttacaagataattgtaacagcaatcaaagaagaccaatcaactgaagagataactgtattgttgaatgaaaaaggggaacctgtgaatgaaaaagattgctaaggaaagcatttcattcactatgtgacgaaatcaatttctttttttaatctttaagtacgaaaaagaggggaataaatacctcttgaaggcaaaacagtgattagtaccttctccaagcgtaaatgtgttaatagtgtcctgcttcttagtgataagaagcaggaattaaaaaagtaggtttaaagcgaattataatttatatgtacacttttttctaaaaaatctttcattaaattatttgccacaaaatcctcgttgagaaacgcggaaggtagtttgttttatatgggaatggcttaatattacccctcttgcactatcggtcattctcgagaaagctattcataaatagtaatctttttattctatcccgcttcttagtgataagaggcgggattttgttttcatatcctcacctaaagatttatccttcccgtgtctcagatctccctttgctaacttaaagagcgcgtgctaatcactatttcttggtactcccccttccttgaaaaagtgcatatctttaaaacaggaaaatcctaaataaatttttctaaaaaggtgtatttttatccaagtatatattatgttttaattatataatattatatttgcaacggttaatatttcgttgggaaacggaacactcgattatgtttagttagtgtaaaagataggaaaacagaaaaagagatttctgtatatagtaaatgtatgatattacatttttcacttttgcatagtataattttataattgttggtactgcttctacaaaatgaagaagcgaagatgttttttacgctaaacaaaattgtacagtgtattgcctacgttgcgaaacgcaggcaatataattaataacaccaacatgaccattgggctgtttgaatgtgaatagatggccgggaacacgcaagtaataatttattagattgttgtaaaacaagacttatccctctattataaatccagtgtgtatcaaccaaagagaggggagtttgcttcaaatatatatatcccctctccactacatcgcatgaagcgaagtttagttaaaaatctatttcttagagcaaggactaaaaaaactcttatgcttagtattcagtatatattgcctacgttgggaaacgtaggcaatattattcttttcttcaacagtatttcatttcaagttctctaaataatcaagcacctgtcggttggctttgtccactttctccatatcataatcgatataaatacttgtagttttacacccaaattcatgaccaagggccaatgaaataacatcttttgacactcctattttatgtgctattgtcgcccatgtatgacgcgcccaataaaccgttagctctggaaataagggaaagcgtttttttactcgtcttcttttaccattaatcaccttttctactagttcaacacttccgatctcttggaggttttcattaagtctgtgagcgtaatctttataattcttgtaacgctcaagaatattaagcaaatacttacttcctttgtatcgttcgattatctcggctgcttcgggttctacttttatattgtatattttcttagtcttagcccttcgatattcaattctgccgtttctaattttctccaaacgacataaatcaacagtatttatgcctacaagatagaaaattaacataaaaatatcaacatattgcttctgatgctcttcgcaaggataatctcttagagtcacaagttcctctggagtcaatgccctttttgcagttgcctcttgttttattttaaatctcctaaatggataacatgaaatagtttcagtattaagagcatcattaaatacagctcggatatttctcatgtgaatactaatcgagttaactttagaggtctctgaaagatgaatctcaaaactctttagccaagcataggtcacatcttcaaatctaaacttatctggtacatccacaaaacgacatatgcgatcaagtgtatattggtagactgccttcgtttggggatttttctttccttccacaaaccttgtataatactgcacaaaagaacatccagtttcttcctgtttctcctctaattttcccctcaataatattcgttgaagatgctccttgaactgttttcctgtcattaagtccaactttccggcaatccttaaattcaataattccgtttcagcacaatgcactcgctgggagatatagccattaaggaatgacttgttaggaccattgatcacctttccttttgtggaatcccactgatctggagataataaaacaccaagattgattaaggcctgctgccttttgtgtgtgacattaattttaagaggaaactttccatctttcctattcacacgtttgtcgaaatacaatttaatagaagccataataaatactcaagatttgcatgatttttgcatgattcggcatccgaaatgcccaaaattcatccaaataatgcaattaaactctttttttttaatgactattagcagaaaaaaaatgccaataatcaagttctaaaacttaaatatcagcatttttctttgtcggggtagcgggattcgaacccacgacccccagctcccaaagctggtgcgctaaccggactgcgctacaccccgaaacacttgtaaaaaaagagaacttccttttttttgtcggggtagcgggattcgaacccacgaccccctgctcccaaagcaggtgcgctaaccggactgcgctacaccccgttcttacagggaagttcctttcaaaagcggtgcaaagatagggactatttttaaatatgcaatagtgaaagaagtattttttcatatttattttttaacatcctatcagtcacatatttggatatataagaaaaatagaagctattaacctaaaaagtcccgattccgtcagaatcaggacttttatgctaaacacacgacagagacaagttattcaagatcctctttgatcacttcatctatttccttgatcttcttttctcttatctttttgctttgggcaggcttctttttggtatcatcatacacattgtctgcacgatccaccatctcttcactccagtcatcatacatgttcgatgccggctgaccggtcagggtggtattttcttctgcgataggtacatccctattaattactttagccatatgttctacgttttattgttatgctataatgacaataaaacatagaaaaagttctctctgttaatgaagtttgatactattagatagattttaaacggtactttccggcaatatttccgaaagctgtgaactaaatcccgtttcaaacgtataatacagaaacatcactataaaaacaaatatcatgagacttagaattcctaaacctatgtatttcattgctttcgccggtattgctttgtttatgggcagttgtaccaaaaataccaccattatttatggcaacggagaagataaccttcccgaaactccacaaaaggagacgacactcgtcactttcaatgcttctgtcgaaagccgaaacctgacccgtgccatgtctcctatgaaaaaaggaatcaaaagcactttgtacgcctatcaaaaggcacagagtaccaccagtcaggaaactctgtttgccgaagggttgtacatcacttcctctccgggggtattatccggaaaagacgggtataaaatgtatcttgcgaacggcatctataatttttacgccgtatccgacaacttctcaaccataccgccttcttttaccggacaagagtcagaacctttattcaatggcatcgattatctttggtggggtagtaccgaccaggatgtaagcagtgcacagatcaatattcccattgtattccagcatgcctgtacacaagttgtcgttgaagtctctgccggagatggtattcaattaagcaggctactatcagctactatcactccgccggttccaggagcgagcatgacactctccaccggagttattcctcccgcaacatcatatgacaaacccgataaaatgggcattaatggatttctggcgcaatatatcatgcttccactgcagaccaatgatccgatgacacttacgcttgaagtggaaacagatggaaacaacaattcgaaaacttatagcgttcagatccctgtcccaagcggagagctgaaagccggagattcttacttattcagtgcggtgatcaatggcagttccgtttctattccttccgtcagcgtaaaggattggacggaagtagacgagacaggtaacccgctttatccatcacaaaaataacaacttttatgcttacacaatttttaagtctattggctactattatcagtgtcatcagcttgctgattgtcacttatggggcgctgattgctatcctctcttttatcctcaatgaactgaagaggataaccggcacctataccccaactaatatacggaagttgagagccgtattcggaacctatttattattggggttagaatttctgattgcttcggacatcctgaaaactgtattggagcctacaatgaacgaactgattattttaggcggtatcgttgtcgtaagaaccatattatcggtattcctgaacaaagaaatcaaagaattagaaacagaaaataactaaaatgtaatgaaccatccatctgtgggggtgtttacattattattaactaaataaaggagatcggatttatgaatactgaaaaagagaaaacttcatcggaagaacagaagaaggctgaaaaggtacttaaagacaaagtacccgtacagcaaaccggaacttacagcgaagccaccaaaaaagaagtgcgcgatgcagtaaaagaactcaatccggacatgagcggattggataggggttaacagcccctatcttcccggaaacatcagtgtaaaacagctgcctttacttatctctgaggaaacagtgatagtgcccccatgcagattcataatctgtttacacaaactgagtccgatgccggaccccgaaggtttcgtcgtaaaaaacggaacgaatattttatccatcacttccggaagaatgccctcaccgttatcacggaccgtcaaactgcagacttttccgggtatttgttccaattccacttcaatctgcggagcagtactttgtccacaggcttctttcgcgtttttaatcagattaatcaatacctgttctatctgtgcacgatcaatgtagagagtagcacctctatgtgtagccgcaaaatggataaacgcatccggaaatagtttcctcagatcagaaaagagttcgtctaccatcaccaatgcacagacaggagtagggatacgggtcagccgacgataattttccacaaacccgagcagtcccttgcttctccgatgaatggtctgcatagcctgcaacatgacaccgtattctttctcgctaagccgttcgggtattccacgttcactcaatgtttcagacagagaaataataggagtaatagagttcataatctcatgagtcaatacccgtatcaatttttgccaggcctccatctcgttacgttccaataccgaatggatatttttcagactgaccagtaacctttccttgttttgtgcagcaaacagggtgcaggacacagccatttcgacagaagttccttgctgccggatacgtactacttgcgtctcgttccaggaagcggtaagccactcctgaggcaattgggtttcttgcccgaccaaagccacagccgcatgattcatccattctacccggcctgagcgatcggtcaccatcacagccgtatctaccttacttaacaaattctcataatattgatgctttacttcttcctcaagcagtctgcctcggaacaatttcagcgtttgcgagagttcatccgccagttcaatcatcatcctgcttttaaacggcggctgaaaactttgcgtcatatcattgaagcggatgctatccgtcagtcgccgcatcatgcctgccaatctcatctgaatggaatagaggtgcactcctgtggcaatcagcaaaagtatcacaatcaaagtgctaaaccacaattcgtaatggaagagcagatatcctccgatggagagtactaccaacaaaaggatgtgcagcactacactgatagaatagcgtttcataagccgagtttttcgagtttacgataaagagcaaaacgggtgattcccagatattcggctgcccgggtgatattgccttcgctcagacgcatggctttttctacggcttgccgttccaacagttccagattgagtacttcctcttcttttttctgccgtacagaagagtggaaaaggaaattctccggcttcagcagagagccgtcgcccagaatcacagcacgctctatggtgtgttgcaactcgcgcacattgccgggccagttatatttcaacaatttattcttcgcctcacgcgtcagcccatgcatatcctttttatacttgcgggcataacgttccagaaagaattcggccagtaagatgacgtcattaccacgttcacgcaggggaggaatatggatttctatcgtattgatgcggtaaagtaagtcctgacggaagtttccttcatccaccattgcccggatatccgcattggttgcacataccagacgtacatcgataggcaccgactgagtggaacccaaccgactgatttgcctcttctcaatcgcagtcagtaacttcgattgcattggaagtgaaagattacctatttcatccagaaacaaagttccgcccgtagccacttccatccgcccggctttcgccttccgggcatcggtgaaagcacccttctcataaccaaacaattcactttcaaacaattgttcggggatgctgcccagatcaattgtcacaaagggctttccgtaacggggagaacaacgatagagcaaacgggcaatcacatcctttccggtaccattctcgcccaagatcaggatattcgcatccgtttcactcaatttattaatggtagcaaacacttcttgcatggctgccgactcaccgatgatctcgttctctgatcctccctgtccgctcaatacttccacctgttccttcagcatattcacttcgtgacgtgactgtcggagtttcatacccgaagacaaggttgccagaagtttctctttctcccatggcttgggaataaaatctgttgcaccagccttgatggcccgtacagctttgtccgtatcggcatatgccgtcataaaaatcacgattgcctgcgggtcaatcttcagaatctgttgcaggctctcaaatccttcctgcccactgatggcgtcacggctaaaattcatatcgagcaggatgatgtccgggccgaaagtagccataaaatattcaatgcgatcgggggtagtagccactttaatcttttcggtataaggttcgagcaaaagattgagggcaaacaatacatcttcattatcatctacaattaatatctttccaagctgttccatattatattacgagctaatttatgttcctttaaaagatgagatataccagttgtacagctcgtcatatcccggttatacatctcgtacatcttatctcactatgcaatgatgccaatgtaagccggatacaactgcttacctttaggctgagggcaaagatacagattatattcatgcgttgtgtgtgctaattcgcactatttttgtgcgtatatgcacatgaagacaaagaagcgcgcacatataaaatgctattaaaaagcaacttacattcatggcataccttttgaatgatttatataaaaagtaaatacacaatgaatctgaaaacgatatttattattgccggatgcagttgcatctcattggtcgccgcacaggaacacacgatggagctctctttggacgaaaccgtgaagcttgccaagcttcagtcgccggacgcacaaacggcacgccatagcttccgttcggcttactggaattacaaatattataaagcaaactatttgcctgctttgagcctgacttcggaccccaatttaaaccgggccatcaacaaagtgacactgggagacggaaccgtaaagttcgtagaacagaatatgctcagcacagacctcaccctaagcctgactcagaatattccctggaccggaggttcacttttcatagagacggcagcgcaacgcatggatctcttcagtgatcatacaacggcttggcagacttcacctattaatataggttaccgccagtcgctcttcggatacaacagtttgaaatgggaccgccgcattgaaccggtacgttaccgggaagcaaaaaaatcgtatgtagaaacactcgaattggtagctgcacgggctacacagaagttctttaaccttgccaccgcacaaagcaattacgaaaccgccaccatcaattatgccaacgcagacacactctatcaatatgcccaggggcgctataacatcggtaccattaccgaaaacgaaatgttgcaactggaactgaacaaactaaccgaagaaaccaaccgaatgaatgcccgtattgagatggacaactgcatgcaggagctacgctcgtatctgggcattcaaagtgatgaagaactaaaagtgaaagtcaatgaccatgtgccggacttcagtgtagaattgcacgaagcgttgttgctggccaacgagaacagcccggagatacagaacatgatgcgccggaaactggaaagtgaaagcaatgtgtcgtatgcccgagccaatgccggactgaaagcggatatttatctgcgtttcggattgacacagacagccgataaactggggagtgcatacaaacggcctttagaccagcaatacgtcagtttgggcattgcgcttcccattcttgactggggacgcggcaaaggcaaggtgcgtgtggcacgttccaatcgcgaccttgtatacacacaggtggaacaggacaaaaccgacttcgaactaaatgtgcgcaaactggtgaaacaattcaaccttcaggcgcagcgggtacggatagccgcacgtaccgacgaaactgcccaacggcgtagcgacgtggcacgcaagctctatctgctcggtaagtcgaccattctcgacctgaatgcttccatcacagagaaagaccaggcacgccgtaattatataacagccctttataactactggagtttgtattacaccttacgcagcctcactctcttcgactttgaaggaaaggcaccactcaccgagaattatgatctgttgatagactgatccgaaacaaaaatcgttaatcgaaaaaaataaaaataatatggatattaaaattgaaaagaaaccctggtacatccgctataaattctacatagccggaggcattgcattcgccgctttccttgtttacgtcattactttgtcggtcggtccgcgcaagctccgcatcgaatcggaaaacatacagatagccgaggtcaaagacggtaagtttatggaatatgtagatgtggaaggactgatccagccaattctcactatcaaagtgaatacccgcgaagccggcagcgtagagcgtatcatcgctgaggaaggaagcctgctccaaaagggagatacgatccttaccctttctaatccggatttgttgcgcagcatcgaggaccaacgggacgattgggagaagcagcgcatcacttaccaggaaaaagagatcgaaatggaacagaaaagcctgaacctaaaacaacaaacgttggaaaccaattatgaactggcgcggctcaaaaagagctttgcgctggataaagaagaatttcgtatgggcatcaagagcaaggcacaacttgaagtatcggaagacgaatataactataaggtaaaaaatgccgaactgcaacgtgaaagtctgcgccacgactcggctgtgaccatcatccgtaaagatctgatacgtacagatatggaacgcgaacgcaagaaatatgagcgaaccacagagcgtctgggcaatctggtagtgaaggcacccctcggcggacaactcagtttcgtcaaagtgacaccgggacagcaggtaagttcaggtgaaagcattgccgaaatcaaggtactcgatcagtacaagattcacacttcattaagcgagtattatattgaccgcatcaccaccggactacctgctaccgtcaactatcagggcaagaggtatccgcttcgcattactaaagtcgtacccgaagtgaaagaccgcatgttcgatgtcgatctggttttcaccggtgaaatgcccgataatgtacgtgtgggcaagagtttccgtgtacagatcgaactgggacaaccagaacaggccattgtcatcccacgcggtaatttctatcaggctaccggaggacaatggatctacaaaaccaatgcatcaaaaacaaaggcagtacgtacgcccatcaccatcggacgccaaaatcctcagcaatatgaaatcaccggaggattagagcccggagattatgtcgttacgacaggatatgatacctttggggaggcggaagaattaatactgaagtaatataaaaaatggatcaaactcaccacagagtagcatagagatggttttcttttaacatcctataaacaagagattaaaactctgtggtgctctgtggtgaaatcaaactcaaaaccattacaaacatgaaaactataaagctggcctggaaagccctggcacgtttcagaacatatacatttatcaatatactgggcctcgccttgagtctggcttgtgtacttatcatcctacggtatatccatcaagaggttactgtaaaccatttctgcaaagaccttgaaaacacctatctgctatattgcgagtacgaagatggaacgcggacaataagcagcaatgaagatagaaataacgaccccaactttatcgatccgttgaaagatccgtctgttctgaaaagtacccggtggattaatttttcggaagacaggattacagtcgggaaacagatatataatgtgaaaaccgtggtgacagacagtgcgtttctgcaaatactgccatatccgtctgtatccggtatctcctctctgaaatctccgaatgatgccatcatcacccggcgattggctaaaagactgttcaaaggagataatccgattgggaaaacaatgacttacagcacaggagacatcatcacgattacaggagtaataggggagccgcctacgaaaagctttttagatttcgacctgattgtatccgaacaattgcaacattcatggtcgcgttcaagctatagcctgatacaactgatgcccggaacggactttaagaagctgaacgtcaagaacgacaagtttatgaagttaaggtgctatatggacacaccgactcgcctgcaattttttccattaaaagatttctatttcgacaagaccattcgtatctatgataacggcaagagtaatttccagagaggcaactataataatatcttagtacttgctgttgtcaccattgctttgttgataatcggtttgttcaatttcatcaatatctatacggtaatgatgctcaagcgtgccagagagtttggagttaaaaaggtatatggtgccggtacaaaggatgtattcgcacagattttcactgaaaactttatcctgacaggcatggctctatgtatatcctggtgtatcatcgaaataaccggtggtatgatggaacatgtgctccggataccgcaaatctccaatacggaatttagtgccatactttctgtcggagtactgattctgttgccattattgacttctatttatccattcatcagatacaattacgtttcgccttccgtatctatccgttcggtgaatgcaggaggacattccatcgtatcccgtgtgctatttttattcgttcagtacctcatcacctttgtgcttattattgtttctctctttttcacaaagcaagtgcgtttcatgttggctgccgatttgaactatactaccaaggacatcattcagtgtcagttatatgccgaacgttcttcatatgatctaaatatgtcgaacgaagagtgggagagacggaaacaaagagaaaaaagtaatctggcttacatcaaagaagagatggaccattctccgctctttatccgttgggagtatggagagaacccgaatcaattggacggtaattataataatgtgcggaatgtgcagcgggatgagttcaagcaagttatttatagcagtctaagcaacaaatatattgaactattcgactttcagctaaaagaggggcgcctgtggaatgactctgttgatcaatggagtgattataaaatgatcattaatgaatcggccaaatcactcttagaaatagataatatagaaacggccctgattcaacccgaaagaagattgtggtggtcttcttcaaaatccgaagaaatggagaagaaccctccatatcagattatcggagtgatcaaagacttcaagatcggtcacttatcaaaaaccactcctccgctcttcattgtttacgaagatccgcggggcagttatagagatcgactgatggcacaaatcattcccggaaaaaagcaagaagccattgccttcctgaaaaaactgcacgatgaaatactgggcgaaggtgagtttgaatacagctttttagaagacgagatagcgaccatgtatcaagaagataagcgaactgccgagatatactccttgttcagtgtcattgccattcttatatcttgcctgggattattcggattatctatgttcgacatccgtcagcgatatcgcgaaattgcactacgtaaagtgaacggagccaccctgaaggagatctatccgctcctgttaaagaaatactcgattattctgggagtggcatttgtcatctcagcacctctgtcctggtatatcatctcaaaatatctggaaggatttgccaacaaagctcctatatcctggtggctgtttgctgttgctgccatagtgacttccttcatttcgctggccactctgatatggcaaatacgaaaagctgccaatatcaatccggccaaagtgttgaaaggagagtagtaaatttgtatttttgtgcgcatgcgcactatgatcgtgcaaattcacacggtgtatctatacaccataagcatataaacaatagtgtctcaacgagttgcttctttggcatacttcttgaaacactatttgtataaacaagaaccaaatgatacgacactattttaaaatcgcattccgaaatctgcagaaatataaaactcagagtatcatcagtgttatcggattggctgtaggaattacctgcttcacgcttgctaccttatggatacgctatgaaatgacatacgatacttttcatagaaaggccgacaatatctatatggttagagcacagctcaaatcggcaaccggtgtactaagtaattcactgccatatcctgccatagaatatctgaaaaagaatttacccgagatagaagacatctgcggaatctctcccataagacggaaacttcagttcaatgataggagtgagaatctgctgactgtcgaagtagactctgcctttatcaacatgttcgatatacgtctcctaaaaggaaatgtcaactttcttaaagaaagaggaaaagaaatagccatcaccgaatcgctggctaaaagttggttcggagaagaagaccctttaggaaaagaggttgagttgggagggcgtctttgccggatatgtgcagtcgtcagcgattggtcacaacactccaatctggcatacagtatcttgctacccatccgccattgccccgactggttaagtgaaacggaacaaatatttattcgcatacgttccaatacggacatcgagagctttcaaaaaagagtatctgctatcaacctctctaaacaagaaaaagagagcagtttgggccaattggccataacgccgattacctcactccgctattcagattacttaaatagagacgaaatcgttatttcgtttaattatatccgttattttgccatagcaggggctctggtcatcctatgctcgctattcaattacctgactctctttatcagtcgtcttcgcatgcgtggccgtgaaatgggacttcgcaaagtttgtggtgctacagaccattcactgttcgcactattctccatcgaatacctgttagtattgattgccggatctgcaacaggaatggtccttatagagttatgtttatcacgatttatagaactggcacaaatatcagaaacaacatcactatattcagaagcaatgatatacatcattgcggtaattatcctgtcatttatcatttcacaaatccctctgtattacttcagaaaacggactttacaaaataatattcaaaacaaaaaagagaccgctcaacgggggatatttcgcaaatccggattggtcatgcagttaattatcagcttaggcttcattttctgcacagctgtcatgatgaaacaactttattatctgaaaaacacagatctgggtatggaacgacacaacttagccaacgttgccatttggatgaagggaggtgatatcaatgaatggaatactaaaattgccagtttgcccatggttacggaaactttgccgccacactatttcccgatcattcccacagggccaatgatgtatacagagatcaacggatgggatgggcagaacaaaacaaatgatgaaacatattcggtaggtatcatgccttcgggcgaagatttcttcagatactacggattgcatttgtcggaaggagaatggttatctgataagagtattacaaatgatgttatcatcaatgaaaccgccgcattaaaattcgggtggaaaagtgccgtcggaaagaaattctactcagaatacgacggacagaaaacattctatcatgtgataggagttgtgaaagactttagccatcttccccctacggttgctccgcaacctctcgcctttgtccgtgccgaagagcagcaatatttgtggggacgtgccagtatcctattcaagtttaaagaaggaagctggaaagcttgtctggacacaattcaaaaaatgcagaacgaagatttcccgtcttctttcatgagactgtataacgaagaggaggaatacaacaaatatctgcgctccgaagatgcacttatgaccttattgggaattgtttctttggtctgtgtcattatctccatttttggcattttctctcaagtgactttgtcatgcgaacaacgacgtaaagaaatagctatccgcaaagtgaacggagctaccataaagaacatcttgcagatgttctttaaagagtatttcattcttttgtttatagccgccatcattgcgtttccaatcagccacatcatcatgcaaacatggattgaaagttacatccggcaaacgactattccgggctggatgtacgtcgccatctttattggcatagcgggagttattgtcatcagtattttctcaagagtatggagtgctgcccgacaaaacccggcagaggtagtaaaaacagaataaaagaggaaaagtatgatacgacactattttaagattgctttcagaaacttattgaaatataaggcccaaagtataattagtataatcggactggctatgggattcacctgtttcgctcttaccgttttatggattcgctatgaaatgacatacgacacttttcacgagggagccgaccgaatccatctaatatacaagaaatccatactggatgctacaggatttgataaaacggtgccatatccggtttcaacttctttaaaaagaatgctccctgaaatagaggatgcatgtgcttttgaattttataaatcggatataactgtcaatgacggtgccacacaacagctataccggatcaatgctgactcttgtttcatgaatatgtttcggatacgggttcttgagggaaaccttgactttttagaatcagccaataagatagccttgacggacaaagctgccaaccgtctttttggaacagaaaaccctatcggtaaagaaatcaaagtctatggagaccccaaaacagtttgtgccattgtcaacagttggagcgaacataccaatttaccattctccatattaggaggcggaatacggcaatggcaggacgtctggtacaataatggattctatgtttttattaaacttcatcaaggagtagatgccaaggcactaagtaataaactgaagcaaacagaaataaagacaaataaaaacgagggggctatcaaggagttattaatgatgcctgtcagtaaatgccattacacgatattggcagacaataatgccattcagttcaactatattattctcttcgctgtgattggaggtttggtgatcctttgttcgttgatcaactatctgtcactgtttatcagccgcctatggatgcgggccaaggagcttgcattacgcaaagtttgcggttcgtccaatcggaacctgtttgctttactgaccatcgagttcctggttatcctgatttcggccggattgataggcatggcattaatagaattagtattgtcggagtttaaggagctttcgggagtgacagacggaaatatatattgggaatcatctctgtattttatgattattattggatgttctctttgcctcttcatgcccgtcactctctatttcaaccgacagaccctgcacaccaacatacagaagagtaacacaaacagacatcgatatttcattcgtaaggcaagtatcctgtttcagttatcaatcagtataggattcattttctgtatctgcattataatgaaacaactctatttcctaagtactacagatatcggcatagaacgtaaaaacattgctaccttaagcttgtatccgcaagacaatctacctcccgcagcagataaaatagagcagatgccttctgttactcaaatactgaaagggcatttctctttgctcccgagaacagtgtctatgtctatggctttcaaggactgggatggcaaacaaccttcggaccccgatatgaacatggaagtactgatggaaagtgaggaattggcccaattctatggcatccggcttttaaaagggaaaatgctgaaagaaggagagagtgacgcaagcactattgttatcaacgaaacggctgcaaaaactttgggctggaacgatccgattggcaagaaattaatcaggcctaacggaacagccaccactgtcatcggtttggtcaaagacttccacactacttcgcccactgttcctgtaaaaccaatagcattcatagccaaagggttttccggtttctatcttggcaaaggagatattctgataaaatacagggaaggggagtggcctaaactgaaacaggctgttgaagatctttgccgaaaagaatatccggacacaaaaatcgtattatccaacatggaagatgtttataacgattatttaaaatctgaacatgcactcttgaaattattaagctgtgtagcaatagtttgcattttgatcgcaatttttggaatattttcgttaataacactggcttgcgaacaacgtcgcaaagagatagctattcgaaaggtgaacggagcaacacttaaaaatatactctctatttttgcaaaagagtacctcatattgatactgctctcttctcttctggcatttccactcggttatgtcgtcatgaagtcatggttacagagctatgtggaacaaacctatataaatgcttggatttacatcgttatcttggcaggaactactattgtcataagcctttgtattggttggagagtgtggaaagccgcccggcaaaatccggcggaagtagtaaaaacagaataaaaaaatagcatgatacgatcttatttaaaaataacatgtaggaatcttctgaagtataaagctcagaacatactcagcattattggactctccatcggttttatagcctttttgttaggtggctactggtactactgggagcaccattttgacagttttcatccacaaagtgaacatacttatgccttgacgactaccggaatatttaaaacagccgatgggttggaaggagaactgaaccaaatacaccagctggcggagaaagagataatagcattccctgaaatagctaaggtatgccatgtcagcgatgtgaaatatgaagcagatggtaaagaaagaagttggataggaatggcagtagactccactttttttgatatcttccaatgccggatgatcgaaggaaattatcataaaacgccttataacgcaaactttgtaattctgacccggaaaatggcaaaacatctttatggagatagcagctgtatagggaaagaagtgaaaattaataaagaaatatcttacaccgttgcgggagtaatggagaattatccgcagaacagtgattttaagtttgagtatctcattctgaataccccccaagccaatattgtgaagcgtagtaccacttatgtattattacactccagtgccaatgcatcacatctgaataagaaaataacatctttccggattaaagaggcagacactcaaagggatacttattccgaatggcatttccacttacgttcattgcccgaggttcatgtctactgttctccggaactcaagggaagatttcaacatatcggcattttggcaacagcaggtttactggcttttgtcagtgcgttaatgaatctgctcgtattgttcatcggacaacagcaacgaaaagcacggtataattcaactttttcaactctcggagcttctaccctgagcttggtaggtaaaaacctgcttgagctcattatacctttattcatcgcttttttgatatcaatgggagtttgtgaattcttatttccatattataaagattataccagtctggtggcagagagtaacagttattattttggtacgattcaaagtatcaccagacaggaaatatttggaacagctctttggatttatccgttatgttgtgttgttttccttgtcataagtctgcttcccatcatcggattgctgaaacgaagcagtcatgggacttcaacgtccttacgaaacggattaatcatcggacaaatatttattggtgctttatttcttttcacttcatgtatgttctacagtcaatatagcttcatgacacacacagataaagggctcgttacagaccatatatggcaaatcgatttaggatatgatgcgacttataataaagactgcagtccttttatagcagcattaaaagaaagctctgctatcgaaggagtgacagctttaacacagccgatccttgttttcagaggggaatggtattgtactttcattaccaatttccctattgaaggacggaattctgatgaatctgaggaggataactgcgtcatcgtacaaaagaattttctcccattctttgggatgaagatgaaagaaggagaatggatacaaaatcaaggaacagaagatatcgttgtcaatgaaaccggggcacgccaacttaatatcccttccttaacaggtcgtcctattatcaataatacaggaaccgatgcaaagtcttatagaatcagtggtattttacgcgacttttactattgtccgatgcaatatcctctgtcgaagaccttctttatgtatcaaagcaatgccgatgctgcgaaagcttacaacggtttccggtacttctatataaaggtacgtccgggaaaagaaaagcaagcattggaacatgtccggcagatttatccggaatatagcaaaggagagattactgaagatgcacagatcattcagctctctacattgatggaattgttcaaccggccggaaaagatgatgttccgtattttcctgctattggctatcctttgcattctcatttcttcattcggagtatactttctggtttcgctctctactgagcaacgcaagaaagaaatagccattcggaaagtaaacggtgcacgattctctgatattttgtgcctgttttttaaagagtatttatggctgactttaaccggtaatgcgattgctcttccgttaggatatatctttatccgccgctggctggaaacctacgcataccacacgggcttccacggatggctgtttatatgtgtgtttctttttaccggtattattgttatcctttccgttataaaacaagtaataatagcagctaaaataaatccggcggaatgtatgaaaagtgaataagccgtcagagtgcgtattcgcaccggaatcgtgcaatatcacacactgtttttgaatgagcaatagatgtaatatacatgaatacagcactatacaagtttggcacatttattgaatctataataacaataataaagacataaaaacaaataatacaaacgaattatgatattacattatataaaagctgcattcaggcaattgataaaacacaaaacgcagactatcatttctatattgggaatcacttgcggattgctttgcttcagtgtttgcaattattataatcgtattttcagtactggcaataaagatttagcgacttatgaacgtcaggctgaaatatggatagagggaaatgcataccaagtaaatattccaatacaagattttgaaaaaaaaatcggaaaagaaaactttgaagcagttgctttttatttcaatgctaatgccaagattactttggatgaaaccatttattataagataagcaaaactgaatgcaatgctgattatttcaaagtatttcctgccaagtgtgtgaacgggtcattacaacagtttggaatatcatgtaatgaggcagtagtaactactgattttgtaagagaattctgtggtaataaatctccgttgggaaagaacatactaactgaaaatggaagaaactatacgattattgccgtcatagagccttatccggcaggaatgaacaactaccacaatcagtatgatgtttttctcccgttagcagaaaacgcttcatttggagcacacaaaatcttattaaaacatgcagaagatgccgaacggctctctcaatatctacaaaagttggaactttttccaaaattcccggaatgggtacctcaaatagtattagaaagcaaaatggagcacaagtccggtgccgaattatggattgcaattcttgggatattggttttattggtaggtatgatcaactatttctcgttcagcataggaacatttgccaatcgctgcaaagaaatcagtctgcgtagtacattaggagctacttattcaggacaattcatgctacttttccttgaacaagctgtcgttatcctgattagtggaataatcaccttagctgtcaccgaaagtttcctaccctggtttataagtacgttttcgtatgagatgcaaaaagaattgtatattgatacctatcggctctggaaatacgaatgccaatacttgattgggatactgttaatcagtgccttagtctctcttctttcatcatggtatattacgcgtaaaactgcggcgcaaggtttaaaggggggaactgctaccggtcagcgtcacatcataagaaactctttattgggtttccaacttttcttctcccttttattcgtcattggaacagtcagtatttggatgcagatgcaggagtataaccgaatagccaatccgtacttgagcgctaaagaaaagaaagaaatcatggtattggatattagaggatataaccgtatcgaagagaaccggcaggaacttataagttttctccgttcacgccactggaacgaaaaaatggcatatagtaacagagattatgctcaggattatgggttcacagaacttatttacgtttcagacgaatattttgaattgatgaatatagattgtaaacaccaggcaggggaaccattttgttatgtaaacgaacagctatatcagactttacagacagattctactccggaaatctatcgttatcaaaacaaaatatatccagtgaaaggtttggtgcatataggttgtgactcaccaagcgcaaagctactcgccattctgcccatttctgcaatgaacaatgaaattggaaaaatttatatccaattagcctccaatgtttctcacaaagatatagaagcagagatggccggggagataaatcaatatttgccgcaaaacgaaccttttgagttcatcagcttatataaagaacaaatcggtctgaggactatctcacttatatggctattcattgtttgctcctctatttgcctactgattacgatgttaggaatttatggtgcaatcagtattgacaccgtacgcagacaaaaagaggtggctatccgtaaaattaatggtgcacgcctgttgaatatttattggttatttgggaaaacctacctgattttattcttaatatcttctattttagggagtttgagcagtttgtttatcatgattacaggtagccaacataaaatcattctatttgattacgctaacccatggctttggatatattctcttttgctcttaataataattatagcaggtactgttagctggcaaatataccatattgcacgaactaacccggcggaagttattaaaaacgaataaaaacaaattacactatacaccattatgatactacatcatttaaaaatagccattcgcagtctcttgaagtacaagactcactgcttgatctcagccatttgcctttcggtaggtatgacctgtttctgtattgtacatttctacattagtgaaatagatggcgccactcgtcgtctgcccaattttgaacagagaatcggactccggatcatgaaccccaacaataaggaagacagggcatggggatggtttctcaccccttcccaaatcaaaacattaacagatcatcctatacccggaatcaaacagctcagctgccgatcctttgaaagtcaagctgaagtcgtctttatcaatcaagaacaggaggaaaagccctatattgtatcttatataagtacagaccccaacttcttcccgcattatcaagcgtcattcttatacgggaatacacttcctgttgaacctgacgaggttgtgttatccgaaagttgtgcccgcaaagtttatggagaaaagaatccagtcggtactctgctgaaaatagtacaattcaaagaagaagaaaagaaaaaagacatttattacaaagtcgttaacgtagtaaaagagttgccgaaagtacttcgtgtacaagccgatatctatttctcttatcgcagagacgatgcccagcaaaatggatttattatggaaggagtgttagacactcctgacggacttgataaagcaaatgaaagcttaaaaggagtcccttttctgcatcgtggagaaatgacatatcttgttgcctccaaagaagccgattcatatcaagagccacaacgcctcattgctatggcattcatcactttcttatcttccttaattttgttatcaggcatgattaactttttaaagtttatcatacaatctttctataaccgaaaccgtgaactggcattgcgcaaaagtatgggagcaactgcccgaagtttgttcggactattgtttacggaagttttctggatgcttaccttctctttacttctttctttggtattgtctgaatgtgtaagtggtcttcttgtatattacattccgccaaaagaaatgattccaatagatatacaaacgttatactctatccaattccaagtatatttaggtttactcataatttgtgcaatcattattctctttccagtcagacgacttcaaagatccggacttgcaagcaatattacggggaaaagtcataaacatattttccgcaatatcatgatgtgcatacaactatgtgtgtgtattttcttcttgggaacagccattgccgttcatttattcaataaggaggataaccgtctataccttcctttatccgaccaagaaacaggccgtactttctgccttcaaatgaatagcgttacactctataaaaacaaagatgctatcctctcacaaataaagatgttacccggagtggaagaaacaagcgcagctttgatgaccggctcattcaactctttcttgaccagcagctatgagtctgcggatcatcgtacacttaccatcaatgtccggcaaggtgatcccagctatttccagttcttccggattccatttcaaggggaaactgttgatgccgatgcaagtaaagtggtctatatcagcgaagccttccggcaacaactggacaaagattctatcagcggaaacgtgaaattaggagaggagagctaccggatcttaggaacctataaagcctgctacggagaaaatctttccgaatataaccaataccacatatccgtatttttccccaccaaagaaatatcagtcatatacattcgttttcgaaatgacattgccttttctaaagcgaaagcacaaatagagaaggtatgccgtaactatgtaccagaatcactggcattagacatagagcccttggacgtaagaaaaagtacgactcagggaattagggacatgatgggtgatatttcactgttacttgctatcattagtatattgcttgtggtgttaagtgtgtattctgcgatctccatggataccgttagtcggcaaaaagaagtagccattcgtaaaattaacggtgctacacctaaagtgatcgctttcatgtttggaagagtctacatcatccaattcatactggcctatatgatcacttatccattgttacggctactgatcattgatatgaccaaaagttctccaatcagcagtgtcagcggatttgcctggggcatttacctgttcattgtaataggtttgcttatctttgtaacaacggcatacaaaatatacagagtgatgcacctcaacccggccgatatcattaaaaatgaataatataaaccaataaaaaattaccattatgattaaaacagtaaacttacagaaaattttcaaaaccgaagaagtagaaacctgggcgttaaacaatgtcagtgtagaagtgaaagaaggcgagtttgtagccattatgggaccatccggttgcggaaaatccactttgctcaatattttaggtctgcttgataatcctacaggaggcgaatattacctgaatgggaaagaagtatccaagtatacggaatcgcaacgtaccaatctccgcaaaggagttatcggtttcgtattccagagtttcaatctgatcgacgagctgaatgtatacgagaatattgaactgccattactttacatgggtattcccgcttctgaacgtaaacaacgggtggaaaaagcaatggaacgcatggccatcactcaccgcagcaaacatttcccccaacaactctcaggaggtcagcaacaacgtgttgccatagcacgtgcagtcgttgctaatccgaagttgattcttgccgatgaacctaccggtaaccttgactccaagaatggtaaagaagtgatgggactgctgaatgaacttaataaagaaggaactaccatcgtcatggtgacacactcccaacatgatgcaggatttgctgaccgagtgattaatctgtttgatggtcaggtagtaacagaagtaagtatttaactttaaacagaatgcaatatccggttatactgaaacttattttaaggagttggtggcgaaataaactattcgcctccatctccttattgagcttagcgattggcattacatgcactatcttgctgatatcattcgttacttatgagtacactatagaatcttccaatccaagaaaagaagatattttccggctaacacaaaatgttccggttatgcaaaagcaaaaacaagggacctttgtttatggaggcagtgttccagacattgtatcccaattcccggaaattgaaagctatctgcgaatgaatgaacttcaaacgtcaggtattcgggtcggaaatgaaaaattcgacaaacaaacaatagttaaagcagatagttcactacttcattttttcccttttgaaacagtatatggtaatttgcctgaagtattatctcaccccggtcaagtagccatcagcgagaaattagctcgtctttattttggaaatgagaattatgaaaatcgtacgattacactggaattgcccgataccatttatacggtacaagtaactgcggtattcagacattatccacaagccatgttacaagctgatatccttacctcgttgtcagatcccgagcagggaagctcttgtatgattctcctgaaaaaagaagtccagtcagcctcatttcgtcaacgatttgaagaaacaggactgcctactttgatgggaaaaggaaattatcagttgttaggtctgcaagattcttatttcaatacagacctctctgatacttcccaaactatggaacatagagaaattacattactcagcatagggctgttatctgctttgttaatattatccatagcctgttttaattatgtcaatcttagtttttcacgattgctgaaacaggttagaatgctccatgtagaaacattaatgggagctacccgtcaatatatacacaagcaactatttgccgatacttttctgactgtcatgcttgcgttcttgctgtctgtactgttgataaatgatcttttaccggcattcaactctcttgtagcagcgcatttaacattcggtttcatattttcgggaaaggtattgccattattagctttgtttattataatcttatctgtcattcccgcactttacatgagcaggaagatgtattctctgtcagaaagtaattaccgcctgttctttattggtaaaaaaaagaggcgcatagtctctatactgattatactccagttcataatatctattgccttaatgacaactttcttaattatacgttcacaattaaatatgatagagaatgaaggaaagcgttatgaaaatataattgaacttggagatggacagcaactatcattactcccaatatataatgatttaaaaagtctacctggaataaaaagtgcgattactacccgcgggaacatttttgaaccctggagcatggcagtacctgtgaaccaggaaggagaggaagaaacactggtcatggttaatttgtacaatgaaagcccgaagtttcaggaactatatgacatgactttacttcatccggaacgtactaaaaaactaatagcccaaaccgctataccggttattgtcaatgaatccttccaacatcattttgtacccgcaggagaagaccccattagtcagccactgaacaaatacaacaagaataatactcagcaaggagctattattgtaggagtaatcaaagactttaaactgacctcttttaatcaaccggtagccccattgcaaatgatcttgcaagaagtccccgagaaccaatgttattatatatctttaaagatcgatccggaccaacgagttgaaaccttacaaaagatacgacaactatgggaaacacatttccctaatcgttcttttaccggtacagatttgtacatgaaatacttgtcattcaatcaagaagtaactaatttctctcaattattattggtatactcaatcataagcttattcttgacagcttttggtctgttcggcatagcatggtacgcatccgaacaacgcactcgggagataggaattcgtaaagtgaacggtgcttccacctggcaaatcgtttggttacttaatcgtccattcttgtgttatatcttaatcgcatttatcatcgcaactcccattgtatatacactaatgttgcactggatagagcaattcgcttatagagcccccattggattgaaagtttttattcttcctctattgataactttagtcatgacaatatgcactgttagttttaacagttggcgggttgcaaagtccaatccaatagatgcaattaaagaatagataatgtcatggatacccctgataaggataaggatattgataacgtaaactataaatggaaacaaaggagccttaaatgaaaaagggattatgtcaaacaacataatccctttcgtatatttattccttatcttatttataaaagatcaagtgccttgaaacatttcaccaacttaccgatagcaaagtcaatctgttctttggaatgtgtagccattaatgagaaacgaatcaacgtatcgttcggagaacatgcgggaggaactaccggatttacaaatacgccctcgtcaaataacattttggttaccataaatgtcttctccatatcacgtacatatagcggaataataggagtggaggtgtgcccgatttcgaaaccaagctcacggaaacactttaaagagtaattggtaatgtcccataagtgttcgatacgttctggttcgtttttcataatctggagtgcggcacgagcagcggcagtggcagcaggcgtattacttgcactgaagatatacgaacgggaattatgacgcaaataattaataatggattcatcagcagctataaaaccaccgatagcagccaatgacttactgaatgtacccatgataagatccacttctttagtcagcccgaaatgatcacaagtaccacgtccgttattgcccagaactcccaagccgtgtgcttcgtctaccatgatattggcatcatatttcttagacaaacgaacgatctcaggcaaattggctatatcaccttccatactgaatactccatctactacaatcagtttcactgcatccggacgacacttctgcaactccttctcaagagattccatgtcgttgtgcttaaacttaaggatggtagaaaaagagaggcgacgtccttcaacaatagaagcgtggtcaagttcgtcacagatcacataatcttcacgacctgtcacacacgaaactacacccaaatttacctgaaatcctgtggaataaatgatagcatcttctttgccaacaaattcggccagttctttctccaattgaagatgaaggtcaagtgtaccgttcagaaaacgcgatccggcacaacccgtaccatatttgcgggtagcttcaacagcagcctcaattactttcggatgattagtcaggcctaagtatgagttcgagccaaacattaacacctttctgccactcattatcacctctgtgttctgttcactttcgatacaacgaaagtatggatatacgcctttagcctttatctgctgagggaggtcgtatttagctaacttctcttgtaataatcccatgaatagttatttatataattcgcttattgactaccttatttataatagtctaaatcctttttccttaacaagtgtttaaaacagggggcaaagataacaaaatatgtttttagctgttctttttctatgaaaaaatatactctttatagttttagaaagctgggaaagggcaaaaattaagatatttatattacttttgtcgaccacaacatataaatgatggaaccaacttgcatgatcgaaaacaagaaaaaaataatattcatcgttaatccaatttcgggtacacaaagtaaggaacttgttctgagtctactggatgagaagatagataaggataagtatacttgggaaattgtgtataccgaaagagccggacatgcaatcgaaatagcagcagatgcggcagatagccacacagatatagtagtggctgtaggaggcgatggaacaatcaatgagattgcccgttcgctggtacataccaatacggcattgggcatcattccttgcggctccggaaacggattggcacgacatcttcaaatttcgatggatccgcgtaaagcacttgagattttgaatgacggattagttgatattatagattatggaaaaataaatggtacagactttttctgcacctgcggagtaggatttgatgcttttgtcagtctgaaatttgccaatgcgggtaaacgcggactcttgacttatctggagaaaactctgcaagaaagcctgaagtatcaaccagaaacctatgaactggaaacagaagacggtacttccagatacaaagccttcctgatagcttgcggcaatgcttcacaatatggaaataatgcttatatagctccacaagctacgttgacagacggtttgttagacgtaaccattcttgaaccatttaccgtactggatgttccggcactggctttccaactcttcaataaaacaattgaccagaacagccgaattaaaaccttccgttgcaagaaattgtgcatccaccgcagttcaccgggagtagtccattttgacggtgatccgatgcaggctgatgaagatatcaagatagagctgattcagaaaggattacgagtcgttgtacctaccgataaaaaaaaagataattccaacgtactgcaaaaagcacaagaatatgtgaatggtatcaagctgatgaatgaagccatcgtagaagacatagcacataaaaacaaagttattttgaaaaaaaataagcagctgatacaaaagcttactaaaaaatagccctttagaaatagtacagaatccgaattaatatgtacttttgcagactactttaacaaaaatataaaaataatatattaaatatgttcagaacgcacacgtgcggagaattaagaatctccgatgttaataaacaagtcaagctgtcgggatgggtacagcgcagccgtaaaatgggaggtatgacttttgttgaccttcgtgatcgctacggtatcactcaattagtatttaatgaagaaatagacgctgagctttgcgaacgtgccaacaagctgggtcgtgaatacgttattcagattgtcggaaccgttaacgaacgctttagtaagaacggaaatattccgaccggtgatattgaaattatcgtttcggaactgaatatcttgaattcggccattactcctccttttaccattgaagataacacagatggtggtgacgatatccgcatgaaataccgttatctggacttacgtcgtaacgctgtccgttcaaatctggagttacgtcataaaatgacaatagaagtgcgtagttatcttgataaactgggctttttggaagtagaaactccggtattgatcggttcaacaccggaaggagcccgtgattttgttgtaccttcccgcatgaatccggggcaattctacgcattgccacaatctccacagaccttgaaacaattgttgatggtttccggtttcgatcgttatttccagattgccaaatgtttccgtgacgaagacctgcgtgccgaccgacagccggagttcactcaaatagactgtgaaatgagcttcgtagaacaagaagatgtaatcgttacatttgaaggaatggccaaacacctgtttaaggttattcgtaatattgaactgacagaaccattcccacgcatgccttggagtgaagcaatgaaactgtatggtagcgacaaaccggatattcgtttcggtatggaattcgttgaattaatggatatcctgaaaggacacggtttctctgtatttgataatgctgcatatattggtggtatttgtgccgaaggtgcagccagctatactcgtaaacaactggatgccttgactgaatttgtgaaaaaaccgcaaattggtgcaaaaggcatggtatacgcccgtattgaagccgacggtactgtaaaatcaagtgtagataaattctatacgcaagaagtattacagcaattgaaagaagcttttggcgctaaaccaggcgatttaattctgattttatcaggagatgatgccatgaaaactcgtaagcaactctgcgaactgcgtctggaaatgggtaatcaattgggattacgtgataaaaacacattcgcgtgcttatgggtagtagactttccactattcgaatggagtgaagaagaaggtcgtctaatggctatgcaccatccgtttacttcgcccaaaccggaagatatccatctgttggatacagatcctgcagctgtacgcgccaacgcttacgatatggtaatcaatggtgtagaagtaggaggaggatcaatccgtatccacgacagccagttacagaataaaatgttcgaactactcggatttactccggaacgtgcacaagaacaatttggtttcttgatgaatgccttcaaattcggtgcgcctcctcacggtggtttggcttacggattggaccgttgggtatctctttttgccggactcgactcaatccgcgattgcattgcattcccgaaaaataattcaggccgtgatgttatgttggatgctcctgcagcacttgatccgtcacaactggaagaactgaatctgattgtagatattaaggagtaagtgaaagagtcagtacgcatttttcgatttgccgtaattggtacgctcaatgcattaatcacagcctttgttatttggctgatgatggatgaattgtcatacgattacattccggctaacattacagcgtacatagtagcccagatacataattttatctggagcaaatattggatctttccgattgaaaataaaaagaataatatctggaagcagatattattcttttgttcagctttcggattggcatatagcgcccagttcctctttttagttactttggtagaatgtggggatgtaaatgagtatctggcacaattcctgggattgtttatctacggaacagtaaacttcatcgtcaataagaaacttacatttagataaaaactattttaaaatattcaataaaaagtcccgcagattatagactctgcgggactttttatatttacagaaacgcaagacttcaatcgataaaacgtttcgtcaggttaccatattcatctatacgtcggtcacgaaggaaaggccaccagcgacgtacattttccgagcgttcaagatctacttcaacaactatattttcgggatgttcatttcctgcctgcgccagatattcaccttgaggaccaacaacaaaactattcccccaaaacaaaataccattggtctgccctgacggatcggcttcgtggcctacacgatttacagaaatcaccggaagtccattggccaccgcatgtgcgcgctgagaaataatccaagcattgagctgacgggctttttcatcatccgtatctgaactttcccaaccgatggcagtaggataaatcaaaatttcagctcctttcaatgccatcagacgggcagcttcgggataccattgatcccagcaaatcaatattcccaatttacccaaagaagtctgtatcggttcaaaaccaatatctcccggagtaaaataaaacttttcgtaataggccggatcatcaggtatatgcattttacgatatttaccggcaatgcttccatcccgatcgaaaacaacggctgtattatgatataatcccggagcacgtttctcaaataaagaagtaacaagcactatccggttagttgccgccagttcggaatagaatcctgtagaaggtcccggaatcggttccgccaattcaaatagatcagtattttcagtttggcaaaaatacaatgaattatgaagttcctgaagaacgacgagttgtgcgccatgagcggcacaagcttcaatgcttttagccagattcatcagattcatcctaatatctgacgtattggcctgttgaatgattcctacttttatttttctcatactcaaattttattatttaatgactcccatcggatattgcattgttacgcaatgtaatgacccgtgttgtttaatgagtgcacgacaatcaatgcccaccacttcatatgccgggaaagcttcacgaagcactgttcttgccagttcatcattttccggctgattataagtgggatagagcacagaaccgttcaaaatcagaaaattagcatacgttgcaggcagtctttctccagatacttctattttatccgccataggtaatgccagtaaacgataagaatcaccagatgccgtacggaatgttttcaactgttcttccattttataaagctcctcataatgttcatctttgggatcggaacacttcacatatgcaattgtatccggagaacaaaacctggctaatgtgtctatatgactatccgtatcatctccggccagataaccatgatccaaccacaacacccgttgcaaatgaaatactctgcggaggtgttcctctatgtcaacccgattcatcggtgcattacgatgcggagacaataaacattcggaagtagttagcaatgtccccataccatcactttcaatagaaccaccttcaagcacaaagtccagacaatctttatattgccctttcagaactccagcctctacagccttacgggttatctgattatctaaaccggcttcgaacttttctccccaaccattgaaagtaaagtccagcaaacatgctccattcgtattcatcagagtgatggccccatgatcacgtgcccaagtgtcattcgtttcgcactccagaaaacgtacattgttcatattcactactccggctatctgattctttaccacctccggacagggagtaacaataagcaaaagttcacgcttggcaatttcacgagctatgttgataaaacattcctgaacctcagaaagcatatatgcccagtctgtttcagcatgcggccatgttaattgcacaccactttgcaaaaaccattccgcaggcagaaaaggagccaacatctctacctgatcatcgacagttaaaccaaagctcagttgcaaatctttctctgaacctcctgaagtaggaagaccgactattattcccattatattttagttttttgaagaataggatacggataacaagtggatacatctttgaatgccacttgctatctatgttatttattagatttacgatcaaaaaatggattcttggaagaagcactaaccggaatagccattacttggcgacaccccttcaaccagtcgagacgttgggcagccaatccggccgaaaacattacacgggtgtctacccgcagatcagcagctgtagcacatgccgaaccaatagcaatacccacatcaatactattcaatgcacaaggcacaccttcggcacgccccgcacaagtagcataaccgcaatgcccacaattcagtccctgtgcttgctcccgtgtacctattaacagaatacattcagcctggagaatattatctgcatcccgcaagaaaaatttcattcccatctcttcgaacataactttcaatgtgtccgaaagtaactgtatttctttatcggtgacaactgcagtttctatgatatcaattcctttccctttaggggcggtacgggcagcagtcatcatctgccgtgccacattcaatatatgctcgtggcgactatctcgttcgttcagtatcatatcttgtccattaattagtgatacaaagataaaagaaatcccgcacatattatgaattttcactaactttgcaagatagatttaaagatacacaatgttacaaatagacaatgcatgcattgctttcggggaggatatacttttttctgagttttgcatgcagcttaaaaaaggcgaaacagcttgtataacaggagaatccggacgtggaaagacttctctgctcaacgcaatcatgggattcgttcctttacggaaaggccgaatcaaagtaggggatattttacttgaacctgccaccattgatattatacgccgacatatagcttggattccacaagagttagcgcttccctccgaatgggtaaaagaaatgatagcactaccttttgcactaaaagccaaccgacatatctctttttctgaggaaaaactcttcacttattttgatgaattaggtctggacaaggacttataccagaagcgggtaggagaaatatccggtggacaacgccaacgcattatgatagcagcggcagctatgctggaaaagcctttgattattgtagacgaaccgacatctgcattggattccggttctacagataaagttttagcttttctacgtaaccagacaacaaaaggaacagctatacttgccgtttcacatgaccgggcattcgcctacggatgtaaccagctaatcacattatagttatatgggaactatcgatatatcttatttcaacctactcgtaggactactactattggcaatcccgcttttctacctgtggaaattcaagaccggattactgaaagccaccctgatagggacggggcgcatgattatacagctcttcctgataggcatgtacctcaaatacctgttcctgtggaacaatccatggattaattttctttgggttatcatcatgatttttgtagccggacaaaccgccttaatgcgcaccgggctaaaacgtgaagtacttttgatccctatatccgttggatttctgtgtagtgttgttctggttggcatgtatttcataggcattgtattgcaactggacaacgtcttcagcgctcaatattttatccccatcttcgggatcttaatgggaaatatgttatcaagcaatgtcattgcattgaatacatattacagcggattgaaacgggagcaacaattgtactgttatctgctcggcaatggcgccacccgccaggaagcacaggcaccatttatacggcaagctattataaaatccttcagtccactgattgccaacatctcagtaatgggattagtagcactcccaggtactatgatcggacagattctgggaggaagcagcccgaatgtcgccatcaaataccaaatgatgattatggtcattacttttacggcttccatgctatcactaatgatcaccatctcactggcctcccgtaaatcattcgatgaatatggccgtatgttacaaataaccaaagaatcccttaaataagtaaccatgacactaaccgactccgttttacaattaataagcgaaatacatattccgggattcttcattaccacagattttctgcaaactggagaatttctcccccaaggaatagatttttttttaaaagaaaagcatgcgaagataattcaaggtgccaacggaagaaaattcatttatcaacaatccggctggcgcatagcattcacattctatccaaccgatcgggtagtcgatgaaaaatatgcaatgaaaaacaaaatgataaagaaacgatatgattattgatgtaaatcaaatcattactatcaatatttgcctatatttgcgaacattaataattaaacaatactacaaagaatatgcacatcagtcacattgctatctggagtacccatttagaagagctaaaaaatttctatattacttatttcaacggaacaagccatgaaaagtatatcaatcctaaaaagggatttgaatcttattttgtcagttttgaccaaggattcgcttccctggaaattatgcaacgacaagacattactaccccggcattaaaagatagcctcggattggcccatttctccttttctgccggtagtaaagaagctgtattgaaactcaccgaacgtctacgcaaggatggctttacgatcgcaagtgagccacggactacaggagacggctatttcgaaagtgcaatcctggatcctgaaggaaatattgtagaaatcactatttgacacgcttagcaagtgcaggtatgtagcgaagttgcacatattgctcgccaggattaatataccgattgtccatcagtatcttcttaactttgaaatctttcagccggtaacggatatatcgttgtgcatttgcaggctgtacttccacaaaggactgaagggcaatcgtcccatcagtccgaataataactttagccttggccgtacgaaaagaaagagcatcgtcctttttcatttctttcatatggtatttatcgatccagaaaatagccgttgccttggaaaggctatctactgtttcttgcaatccattttcctcttcagtagcagatataggagtttctttatgctgttgacatgaaataataaaaaagagagaaaaaaataataatagaattgccttcatcggtttgtgcttttataaatttggaggtaaatatattaaaaaatcaataaaagcaaggtaaagtattggctttttcttatctttgcaacaaattttctactgataatgaaaattaaagaaattgtaagcgcccttgaacggttcgcgcctctgccattgcaagacggatttgataatgccggcctgcaaatcggactgacagatgcggaaacaacaggggctttgttgtgtcttgacgttaccgaagctgtgcttgacgaagctatcgcgtccggctgtaatcttgttatatcccatcatccccttatttttaaaggttataaatcgattaccggtaaagattatgttgaacgttgcatcttaaaagcaatcaaaaacgacatcgtcatttattcggcccataccaatcttgacaatgctccggggggagtgaactataaaatagctgagaaaataggattaaaagatgtacgcatacttgaacccaaagagaactgcctgataaagttagtcacattcgtcccgaccgcacaagccgaagaggtccgtaatgctttattcactgccggatgtggatatataggcgactatgactcatgcagctacaacacagaaggcgagggaactttccgtgcacaggaaggaagtaaacctttttgtggaaatataggagaacttcatcatgaagcggaagtacggattgaaaccatcctgccggaatataagaaaagagaggttatccgtacgttactattgacacatccctatgaagaaccggcatacgacttatatcctctttacaatagttgggcacaggtcggagcaggaatcatcggagagctggaagaagctgaatcggagcttgaattcctgaagcgtataaagaagacatttgaagtagggtgtttgaaacataacaaactaacaggccgcctgattcagaaagttgccctctgtggaggggcaggagctttccttattccacaagctataggtagcggagctgatgtttttatcacaggtgaaattaaatatcatgactactttggtcgtgaaacagacattttacttgcagaaataggacattacgaaagcgaacaatacacaaaagaaattttttattccataatacgggatttatttcctaattttgcactccaatttagtaaggttaacacgaatcccattaaatattttaagtaaaatggcaagagaagctaaaaatgaaccgaaagagttgacagtggaacaaaagttgaaagctttgtttcagctgcaaacaacattatctaaaattgacgaaattaaaacgttaagaggtgaacttccattggaagtgcaagaccttgaggacgaaattgccggtctgagtacacgtatcgataagatcaaggcggaagtagacgaactcaaatcagctatcgccggtaagagagtggaaattgaagcagccaaagcttcggttgagaaatataaatcacagcaagacaatgttcgtaacaaccgcgaatatgacttcctgacaaaagaaatcgaattccagtccctggaaatagagctttgcgaaaaaagaatcaaagaattcactgcagaagagcaggaaaaatctgaagaaatagagaaaaataccaaagcactggaggaacgccagaaagaccttgaccagaaaaagaatgagctggacgagatcatcgaggaaactaaacaagaggaagaaaaattgagagataaagctaaagatcttgaaacaaaaatagagccgcgcttactccagtctttcaaacgtatccgcaagaattcacgtaacggattgggtattgtttacgtacagcgtgatgcatgcggtggttgttttaataaaattccgcctcagagacagttggatatccgttcacgtaagaaaattatcgtttgcgaatattgcggacgcatcatgatcgacccggaactggcaggtgtggagatagagcacaaagtagaagaagcacccgttacaaccaaaagagctatcagaagaaaagctgaataaagccttgcattgatattctgatggtccaattttaaaagttcggaattcatcatatttaaaacccgtaattttactatagcccgattgttagcatagtaaagttacgggtttattcattaatatccgtttcttcaataaagaaagtatattccctttaagcatagtgattctcttatagacaggataaacaaatatttcttttcgttgttatgttttcatttctaaataacctaaacttatgaaactacgaataggaaatatcatgttcttgctgtttctttcgtccgtagcctttccacaggctacgaaccgctatctggacaaacctttgccacaagaatgggaagaagatgcacaaatttttcagcaagtattgccggtggatgaccaatggtggaaagcttttcaggatccggttctcgattctcttatttctgttgcggtcaaacaaaactactcgatactgaccgctattgaccgtatcaatatggcaaaagccaacctgaggatggaacgtggaaacttttttccaacgatcggactgaatgccggatggactcgtcaacaaagtagtggcaataccagtgaattgcctcaatccactcagcattattacgatgcctcgctgaatatgagttgggaattagacctcttcggaagcatccgtaaccgtgtaaaagctcagaaagaaaactttgctgccagcaaagaagagtacaccggtacaatggtatcactctgcgcccaagtagcttcagcatatatcaacctgcgggagctgcaacaagaattggcagtaatacaaaagaactgcgcatcgcaggaagccgtattgaaaatcacagaagtgagatacaataccggactcgtttctaaattggacgtagcgcaagctaaatctgtgtttttcagcacaaaatcctctatcccccaaattgaatcgggtatcaatcaatacattactacccttgctatactattaggcacttatcctcaggagatacgtcccacattagagtctccaggaatattgcctgactatatggaaccaattggagtaggacttccggccgacttactgcttcgtcgtccggacatccgtagtgcagaacgaagtgtgaatgctcaagcggctttagtgggggcatccaaatcggactggctgcctcagatttttctaaaaggttcgcttggttatgctgctaaggacctgaaagatctgacccatcataagagcatgacctatgaaatagcaccggcactaagctggacactttttaaagggactcaattggtaaatgccaccaaactggctaaagcacaattaaacgaggctatcaaccagtttaatcagactgtattgactgccgtacaagagacagacaatgccatgaatgcttaccggaactccatcaagcaaatagtagctctacgcgaagtgcgtaatcaaggacaagaaaccttgacactctcactggaactctataaacaaggattaaccccattccagaatgtactggatgcacaacgctcgctgctcagttatgagaaccaactggtccaagcaagaggatattccttgctccagctgatagccatgtaccaagccctgggaggcggatggtccggaaacctaaatgattaactataaagacctatcataatgaaaaaactaatgtatatttttctcatctttcctttggtaatgaccggatgtaaaggaaaaaaagaagccggaagaggagagatgcctactccggaaatcagtgtggcatatccactcgtacaaaacattaccctgacaaaagattatccgggatatctgactaccgaacaaaccgtaaatctggtagcccgggtcaacggcaccctgcaatccgcctcattcacaccggggactcgtgtaaagcaggggcaactcctgttcgttatcgaacctactatctacaaagataatgtaacacaggctgaagcgcaattgaaaactgcgcttgcacaactggaatatgcccgcaataactatacccgaatgaaagaagctttgaaaagtgatgcagtcagtcgtatacaggttttacaggcagaatcaaacgttgccgaagccaccgctgctgttagcaatgctgaagccaccctgaatactgcacgtaccaatctgggatactgctacatccgtgctcctttcaatggaacaatcagccgctcactttacgatgtaggaagctatatcagcggagccggacaacctgtcactttggccacgatctataaagacgaccgaatgtatacctactttaatgtagcagacaaccaatggctatccatgctactttcacaaaccggtaaggagaaagaacttcccaaaaatgttatcgtacgcttgggagaaaacggtacacaaaactatccggctacactggattacttatcgcccaatgtagacctgggtacaggaacacttaacgtacgcgccaacctcgataatccgaaaggggttctgaaaagcggactatacgtcagcattacattgccatatgccgaagcgaagcaagcattgctcgtaccagaagcctctattggaacagaccagttaggaaaatacctatatattgtaaatgattcgaatgttgtgcgctatcgccacatcgagccgggacagctggttaacgatacgttacgtcaaattaaaagcgggctttcggctaaagagcaatacgtcacaacggcattaatgaaagtgcgtgacggcatgaaaatcaagccaatatcagtcaatcacgagtcacaaacctctaatcattaagtacatgttttcaaagttctttatcaatcggcctatatttgccacggtactggcattgattatcgtggtggcgggattggtaacattaaatatattgcctgttgcacagtttccggagattactccacctacagtacaggtgtctgctttctatccgggagcaaatgctgaaactgtagctcaaactgtcggcatccccattgaacagcaagtgaacggagtagacggtatgctttacatgagttccaccgcatccagttcgggtgcctattcactgactataacctttgccgtaggcacagatatcgacatggctaccgtacaggtacagaaccgggtaagtgtagcgcaatcttcactgccggaaccagttgtagtccagggagtaactgtacagaaacaatcatccaacatcgtgatgtttctcacaatgcaggcaaaagactctgtatacgacggactatatcttacgaattatgcacaactaaatctggtagatcaactaacacgagtaccgggtgtaggagctgtcaatgtaatgggggcaggaaactacagtatgcgtgtctggctcgatccggaagcaatgcgtatccgtaatctctctcctgcgcaagtttatcaagctatccagtcacaaaacattgaagtcagtgccggctatatcggacaacctattggaaaaaataataataacgcctaccagtatacgttgaatgtacagggacggctgacatctcccgaggagttcggtaacatcattatccgaaccggagaaggagggaaaatgctccgactgaaagatatagcacgcatcgaccttggcagttcctcgtacaatgttgtctctaaactaaaaggacatcccactgctgccattgctatttatcaacaaccgggttcaaactcgcttgatgtttccaaaggagtcaaagctaagatgcaggagcttgcacaaaacttcccggcaggcgtcagctataatgtgacattggatacaaccgatgtcatcaatgcatctatcgatgaagtattggtaactttcctggaaaccaccttactggtagtacttgttattttcctgttcctgcaaaactggcgggctgttatcatcccatgtatcaccatccctgtatcactgattggtactttggcagtaatggctgctcttggattctcaatcaatactttaactctgtttggattaatacttgccgtagcgatagtggtagacgatgcaatagtagtggtagaaaatgcttcccgattattggaaacgggacagtattctcctaaagatgccgtcaccaaagcaatgggagagatcaccggcccaattgtcggggttgtactggtattgcttgctgttttcataccaactacattgatcagtggcatctccggacagctttacaaacaatttgccttgaccattgccgcttctaccgtattgagtggcattaactcgttgacactgacccctgcattatgtgccttgtttttagaacataacaagccatccaattttttcatatacaaaggattcaacaaagtatatgacaagacacagaatctctatgaccgcattgtaaaaggattactcattcgtccgggacttgcactgatctcttatgggatcattacagcgatagctgtcattctgttcatgaaatggccttcaactttcgtgcccgatgaagatgacgggtattttatcgctgtcatccaattgccaccggcatcgagcctcgaacgcacacaagctgtcggacaaaaagtgaaccgaattttagacagttatccggaagtaaaagactacattggtatcagtggcttttctattatgggaggtggcgaacaatcaaatacaggtacctatttcgttgtactgaaaaactgggatgaacggaaaggaaaagaacacactgctgcagctgtagtacagcgtttcaatgaaatggcttatggcattcaggaagcgcagatatttgcgatggtgcctccggccattcccggcttaggagcctcgggaggtttacagttacaactggaagatcgtaacaatctgggaccgacagaaatgcagagagctatcgaaactttgatggctacctatcacacacaaccggccctcgcatccatatccagtatgtaccaggccaatgtgccacaatacttcctgaatattgaccgtgataaagtccaatttatgggtatccagttggacaatgtattctctacgctaagttattacatgggggcagcctatgtcaacgactttgttcagttcggacgcatctatcaggtaaaaatagaagccggggaacaggctcagaaagtgatcgatgatgtattgaagctcagtgtccccaacgccgcgggaaatatggtaccattttcttcttttacaaaagttgaagaacgtctgggtatggaccagataagccgctacaatatgtattcaacagcttccataacctgcaatgtagcctcaggaagtagttcaggtgagggaatacaacagatggagaatctcataaaagagcaactgggcaatgaattcggttacgaatggacttcggtagcttaccaagaaacgcaggcaggaaacacaacgaccattgtattcattatggcactattggtagcatttctggtattggcagcccaatacgaaagctggacaagcccgttatcagctatcatgggactaccaatggctctgttgggcgccatgataggctgcttcgtcatgggtaccccagtgagcatctacactcagattggaattattttgctgattgccctttcagctaaaaatggaattctgattgtagaattcgcacgcgatttccgtgccgaaggcaactccatacgtgacgctgcctatgaagccggacacgttcgtttacgcccaatccttatgacttctttcgcctttgtgttaggagtaatgccattgctgttcgctaccggagccggggcacaaagccgcattgctcttggggcagctgttgtctttggtatggcactgaatacattgctggcaaccgtatatatccccaatttttatgaattgatgcagaaattccaagaaaacgtcttggatcggaagaaaaagaaatagttctctatatcactatctctattgtaaaaaacgtccttttcatttcacagtctattgtcaccgagctgaatctcggatgacaatagactttttcttatacttatcacaaaaacaattaagtgctttcatgcttattccataaaaataggaatatgttgagttattaggtaatagttctgattataaacaaattatgaagacaacaatctgtcattacgaagttaactttaacagtgtgttaaagttaacttcgtaatgataaacaattagctttttacatttacgatattaacttcctaaagataaatcaataaaggtccaaattcactgttaacattgttaattttacaagatagcataatccggaatatcagccagaaatgaataactttgagtatcataattcatccggcagcaatagtgttgcataccattactgacaaccagataatcaaccttcaaaaccatattataacgagtaatctgatcaaaaacagcttgtgtgatctcaatgtggggagctttgtattcaacaatcattctggcagtaagatcacgcttataaagcactgtgtcacatcgtttcttggttccattcaagttcaacagcacctcattggccatcagagacgacggatatcctttatagacaataagaaagtgtacaaagtgctgacggacccattcctcgggggtcaacgcgacataacgacggcgaatcacatcgaaaataacattttttccatttcgagtggcgattttagtgtcaaatactggtaggtttaacgataacatttactatttttgtaagttaaataatggcttcctgttattggaagcacaaatttaatggaatcttatgaaaacaaagcaagaaatcgtagctaattggctgccccgttacaccaaacgtaatctggaagactttggagagtatatcctgttgactaacttcaacaagtatgtagaaatatttgcggaaaaatttaatgttcctatctttggcagagatgccaatatgatatctgccagtgcagaagggattacaatcatcaacttcggcatgggaagtcccaatgcagccattatcatggatctgttaagcgccatttctcccaaagcttgtctgtttctgggcaaatgtggaggaattgataaaaagaacaaaataggtgatctgatcctgccaattgccgctatccggggagaaggtacctcaaacgactattttccacccgaagttccatcgttaccggcatttatgttacaacgtgccgtatcatcggccatccgcgactatgcacgcgattactggacaggaaccgtctacacaaccaaccgccgtatatgggaacatgatgacgcctttaaggaatacctgaagaaaactcgtgcaatggcagtcgacatggaaacagcaaccttattcagttgtggctttgccaatcatattccgaccggtgctttgctgcttgtatccgaccagcctatgattccggaaggagtgaaaaccgataaaagcgataatatagttactaaaaactatgtagaggaacatgtagagataggtattgcttcattacgaatgattattgacgaaaagaaaactgtaaaacacttgaaattcgactggtaacgccacaccaacatttatatggcaaaacaagaactgacttgcgacgatatcctcaaagaattgagggccaaacaatatcgccccatctattatttgatgggagaagaatcttattatatcgacttgatagccgattatatcaccgacaatgtattgacggatacagagaaagagtttaaccttactgtggtttatggcgcggatgtggatgtagcaaccgtaattaatgccgctaaacgttatccgatgatgtccgaacatcaggttgtaatagtaaaagaagcacaagctatacgcaatatagaagagctatcttattatctgcaaaagccattaaattcaactatcttagtcatttgtcataagcatggcactttggatcgtagaaagaaattagctgcagaagttgaaaaagcaggtgtcctattcgaatctaaaaagataaaagaagcgcaactacctgcatttatcagttcgtacatgaaacgtaaaggcatagatatggaacccaaagccactgcgatgctggccgattttgtagggactgatctcagccgtctaacaggcgaactggaaaagctaattattacattacccagtggtcaaaaacgtgtcacacctgaacagatagagaaaaacataggaattagcaaagactataataactttgaattgcgtagtgcactggttgagaaagatatactcaaagctaataaaataataaaatactttgaggaaaatcctaaaacaaacccgatacagatgacactttctttactatttaatttctactcaaatcttatgttagcgtactatgcaccggataaatcagagcaaggagtagccacaatgttaggactaaaaaccccatggcaagctcgcgattatctggcagcaatgcgaaaatacagtggagtaaaaacaatgcaaattgtaggagaaatacgatatgcagatgctaaatcgaaaggtgtgggcaatggttcaattagtgatggagacatcctccgcgagttggtcttcaagattcttcattaaaaacaatccactttaaatctactccctatatgcatatattttgccggtataaaatatgtgtatggggagtaaatatatcctcataatccgaaatatactttcctataattatccactttattcttcacatcaattttacactcttttccctgtctctaccatacatataaaacttaaatatagtattctgtttcttctaaaagaaaacagattttgcatggggcgaataagtatactcccaatagaacaatataaaaatcaacaaaaagaagataacatatcccatataataaaattgtgattatactgattcctatcaatcatctatatgggtgtgatatggtgctaatgcttcatcataatgctatctaaagtagtataaattatatcataatgctatttctctatgtatagattcatttttctagaatataaaaaaaatatatatcaaaaaacaagcatattcttctatatatcaaataattaggtaatatttgacttcctcagaatcgaataatttcatttggataaccaaccatacggaaataacgcaaaaatttggcattatagcctaaatgtaaggtatgatgacacgctattctttatatctatatccaataggcataaagacaaaagcaactcccatgctatttgttgcatatataacgatacaatatgacaattgtgaataaggactatagcccttatatggatttacaaaagtaataatatcatttttgtatagcaaataaatatagcacaaatgtaaatagacaacattacatatgtgtatttacatttgtagatgtaataggggagtagttaacatttccttttttacatgctaatgacagaataatcaataagaaaaaaaatatatatcaatcaaatattcaactaatgcatgaaaatatggacacatttgtaataaacaagcaacacaagataaaatgcatagatacatattgcaataaatcaatatattataatatctatataaagtaatactttatatattgctacgactgtataggcaatacaaacagaattaaagaggaagtcctatcttgcgtttacaatagtaaaatatgaattatgtatttgtaatttgcttttgtgatttttattttttacttttgtgcattagtaaatgtgccatttacttttgtgaattaatatataagtcatacatttgtaaaaccttcaaaggatatggaaataaaagataggattaaaatgatcatggaaaaagagaatatggcttccggtgctttcgctgaaagcataggtatccaacaatccactctctcgcacattttgaatggccgcaacaatcccagtttagatgttatcatgaaagtacatcaaaaatataattatgtaaatttggaatggttattatatgggcacggcaatatgtcggaagaaaccattcaaccgacttccgattttcagccttctttatttgctgagaatgctataattccgtccaatgagacgatggctccggaaaatcgcagagaaacagcgttagaaagccccgaaacatcccataaagagattgtaaaacaggaaattagatatatagaaaagccttccagaaaaatcactgaaataagaattttcttcgatgataatacatacgagacattcagaggagaaaaataagacagataaatcactgtttgcacaatttcccgtatctttgcaacacgaatacgaatttactcacaatacatgaaaaaatttattttagatctgacagtaactgagaatctcagattgcattctaattatgttctgctgaaattgacatctcagtccgtcctcccggatatgctaccgggacagtttgcggaaattcgggtggatggttcacctaccaccttcctgcgccgccctatctctattaactatgtagacagacaacgtaacgaagtatggtttctgattcaactcatcggtgatggaacaaaacgccttgcacaagccgctcaaggagatataataaatgtagtactcccgcttggaagcagtttcacaatgcctaaaacaccttctgacaagttactattagtaggtggaggtgtagggacagctcctatgctttatttaggcgagcagctgttcaaaagcggtagcaaaccaacattccttttaggagcacgtagcgacaaagatctgctccaactggaagagtttaccgcttacggagaggtttacaccacaacagaagatggcagttatggcgaaaaaggatatgtcactcaacattctatattaaataaaataaacttcgaacagatatatacatgcggtcccaagcccatgatgatggcagtagccaaatatgccaaagctaatcatatcaattgtgaagtatcattggaaaatacaatggcatgtggcataggtgcatgtctttgttgtgttgaaaatactacagaagggcatttgtgcgtttgtaaagaaggtcctgtttttaatataaataaactattatggcagatttaagtgtaaatattggtaaactacaaatgaagaaccccgtaatgacagcatcgggtacatttggatatggtgaagagtttgcagattttattgatataacgcgaataggcggtatcattgtgaagggtactactcttcacaagcgtgaaggtaacccatatccgcgtatggctgaaactccttccggaatgttaaacgctgtaggactgcaaaataagggtgtgaaatatttttctgatcacatatatccccgtattaaggacattcaaacccatatgattgtgaatgtttccggatcggctattgaagactatgtaaaaacagcagagattattaatgaacttgacaaaattcctgctatcgaactaaacatctcatgtcctaatgtaaaacaaggaggtatggcttttggagtaacaactaaaggagtatcagaagttgttcaggcagttcgttctgcttacaaaaagacacttatcgttaagctttcccccaatgttaccgatatagccgaaatggcacgggcagctgaagctaatggtgccgatagtgtatcattaattaatacattactgggaatggctattgatgctgaacgcagacgtcccatactgtcaaccgtaaccggaggtatgtcgggagcagctgtaaaaccaatagcattacggatggtatggcaggttgctaaagcggtaaatattccagtcataggattaggaggtatcatgaactggaaagatgccgtcgagttcatgcttgcaggggcttcagctgtacagattggtacagcaaatttcatagatccggccatcaccatcaaagtaatggatggtataaatgattacctggaaagacatggatgcaagtccgtttctgaaattataggtgcacttgaggtatagtaacaaacagataatagcccttcgtcacaattagccataaaaaagttattcaaacatggatattcctttctctgttaatcccggaataagttagacaaattctggtattaaatagagaagttccatgaaaacaaattccattattaatagtatagtttcataaaaaaagaatgtcttgctaaaagacaagacattcttttttacatacaataagaattagtcttccaataaatcggggcgaagtcttttggtgcgctccaacgattgttgaagttcccactctttaattttggcttcatgccctgaaagcaagatttcaggtaccttccaaccattatactctgccggacgggtataaacaggagctgccaacaaattatcctgaaaagaatcagaaagagcagactgttcatcagaaattactcccggaataatccgcactatagcatccgccatcacggcagcagccaattcaccaccagtcagaacataatctccaatactaatttctttcgttatcagatgctcccggatacgataatcaatacctttaaaatgcccgcataagataataagattaccagataatgataaactgttggccatcctctgatcaaactgctcgccatccggagtagtaaatatcacttcatcataatcgcgttctgctttcaaagcattaatgcatcgttcaataggttctatcttcatcaccataccggcaaatccaccaaaaggatagtcatctacccgacgatacttatcttctgtataatcacgcaaattatgaatataaatctcagcaagccctttgtcttgagcccgtttcataatagaacaattgaagaaaccctcaatcatttcgggcaatactgttataatatcgatacgcataatctttaatttttcgcaaaagtacaaatattcgaagagaaacctgtatttttgcctaaaacaatctaaagaatatatgactgtaaaagaaaaaatagatcagcttcgaatccaactccatcaacataattacaactattatgtgctgaatgctccggaaatctccgacaaagaatttgatgacttaatgagagaactccagactttggaacaggaacatccagaatataaagatgaaaactcacctactatgcgtgtaggtagcgatatcaataaaaactttactcaagtagctcataaatacccaatgctttcattgtcaaacacctattctgagaatgaagtaaccgatttctatgacagagtacgaaaagcattgaatgaagattttgagatctgttgcgagatgaagtatgacggtacctcgatctctttgacctacgaaaatggtaaacttatccgtgccgtaacccgtggcgatggcgaaaaaggagacgatgtaacagacaacgtaaaaaccattcggagtatccctcttgttctgcatggaaataattatccggatgttttcgaaatccgtggagaaatcctaatgccatgggaagttttcgaagagctaaaccgggaaaaagaggcccgtgaagagcctcttttcgctaatcccagaaatgccgcttcaggaactttaaaattacaaaactcagcaatcgtggcttcccgaaaactggatgcctacctctactacttgcttggcgataatttgcctactgacggacattatgaaaacttgcaagaagcggctaaatggggcttcaagatttctcctctaatgcgtaaatgccaaacattacaggaggtattcgattttattaattattggaacgtagaacgtaaaaacttaaatgttgctacagacggaatcgtactgaaagttaacagtctcaaacaacaaaaaaatcttggattcactgccaaatctccacgctgggcaatagcctataaatttcaggctgaacgggcactcactcgcctgaatacagtatcttaccaggtaggaagaaccggagctgttacacctgtagccaaccttgatccggtacagctttccggaacagtcgtaaaacgcgcatctctacacaatgcagatatcatcgaaggactcgatctacatataggtgatatggtttatgtagagaaaggaggagaaatcattcctaaaatcacaggcgtagatgttgctgcccgttttatgatcggtgaaaaagtaaaattcatcactcattgtccggaatgtggcagcaagttaataagatatgaaggagaagctgcccactattgcccgaacgaaactgcctgtccaccacagatcaaaggaaaaatagaacatttcatcagccggaaagcaatgaatatagacggattaggccctgaaactgttgatatgttctatcgtttagatctaattcataatacagccgatctttatcaattgacgactgatgacattaagaatctcgatcgtatgggagacaaatctgcggaaaacatcatcagaggaattatgcaaagtaaggaaattccttttgaaagagttatttttgcattaggcattcgttttgtaggtgagacagtagctaaaaaaatagctaaatcattcaaagacatagtagaattggaaaatgcagatttggaaactttagtcagcatcgatgaaatcggcgaaaaaattgcccagagtattcttaactattttgcaaacgattcaaaccgtaaattaattgaccgattgaaaatagcaggattacagttatacagaccggaagaagatctaagtgagcatactgacaaattggccgggcaatccatcgttattagtggtgtgtttacccatcattcaagagacgaatacaaagatcttattgaaaagcatggaggaaaaaatgtgggaagtatttccgccaaaaccagttttatcttggccggagataatatgggacctgctaaattagaaaaagccaataaactggggattaaaattatgaacgaagaggaatttctaaagcttatattgtaacatttttctgctatattcttattttatatattattattgctgtaaaaaaagaaaatattcgtacttttgcgagcaaattatttagagattattattaatactcatgatacagactagattgaaaggaatgggggtagcgctgattactcctttcaaagaggatgaaagcgttgattacgatgcattaatgcgattagtagactatctgcttcaaaataatgcagattttctgtgtgtgctgggaacgacagccgaaactccaactctgagcgaagacgagaaaaagaaaatcaaaaaaatggtaatcgaccgtgtcaacggaaaaattcccattctattaggagtcggtggaaacaatacacgagctatcgtagaaacactcaaaaatgatgatttcaccggagtggatgccatcttatccgtggttccttactataacaagccctcacaggaaggaatctatcaacattataaggcaattgcaggcgctacagaacttccaattgtattgtataatgttcccggtcggacaggggttaatatgaccgcagaaacgactttacgcattgctaaagacttcaaaaatgtcatagcaattaaagaagcatcaggcaatatcactcagatggacgatattatcaaaaacaaaccagccaattttgatgttatttccggagatgatggcattactttccctttaatcacattaggagctgtaggggttatttcagttattggaaatgcttttccacgtgaattcagcaggatgacacgcctggcattgcaaggtgactttgccaacgccctgaccatacaccataaatttacagagttatttaacctgttattcgtagacggaaaccctgccggagtaaaatcaatgttgaatgcaatgggaatgatcgagaacaaacttcgtttgccactggtaccaacacgtatcacaacatttgaagccattcgaaacgtacttaacgagttaaatataaaatgctaataactaaatcattataagaaaacaaagagtaaagttacataaaaaatgactttactctttgtttgtatatccagacctttcctctgtcacacagccttcttcgtattgatgtttttcttgaagagaaagacagtccatcaacttacgttgatcccggtatgatcctaatggcggcataacaaaaaaaggatcaatgaataactctgaggggtgaaattataaattcttatctttgccttcaaaacctttaaagctggtttggctgccagtataaagaacagcaaacaaaattatgaatatcttaagatttcttttaagtagcctttcatgggctatgggtggagttcttgtattagcaatctatgcgtatagtgaactggtctacttgatttttatttgcattgcaataataggattgaccatctactatagaaaacccctaataaaaatgtatgcagaaatctttaatgaattaggaatcactagatacattatattaattaaaaatcttaagaagttcaaagaacctatttacaaactaatcagttctataagtttatggtaatcttattttaagtatctttgtagtgaaacaataaagagaatgaaagaagcactatcacaacttcaatcttcactagaaaaagttcaaagatagggaaaaggattaaaaaaaggtttcttctgattcttcaaataaaaagagaggactggcttttccaatcctctttttctatttatttgcgtcttaactcattatctatttgctgtgaaatttgtcctttaacggttctgattacctcattaatataatcaagaataggcttagggtctatagtcttatctttgtattccatttgaaaatgtaagtgttctcctgtgctgcgcccagtacttccactaatgcctattggttgcccagcttcaacagcttgtttcgcatttacaagcacactgtataaatgcccatagatagaagtaaaatcaccatgacgcacttctacataattgcccaaccctttattttttcctgtttttacaaccattcctggcattattgaataaacatagtcgttgttacctttaaggtctatccctctatgatttgctacttttccagtaaatgggtctttccttttaccataatgggaagttatcaccattgaatcaatgggtaaagacaaataccttctttgcttccagtatgcaagccgttctgtagtcaaagcatcattgacaacaacagctttttctttttcttctatcaatttgttttctgtcgttgctaatacaggttccgctttaggaatatcctttttctgcaataccgtattaaactgacagtagccattcactgaaaaaaacaatgaataagcaaaaaatatagctattttattcttcatattgatatttttattacttttgagcaaaaatatacattacatggataaaaagcaagctatttttaatgaaaatgatattccatataaagaattagaactaattggagtatcaaaagagcaaatatggtctttggataggactaatatcacagctctgttatcgggaaaaagaactagtttactagacctcacttttcatgataacaagggagaggaaataagcatgaaaggaaaaataagtctatactggaaagacaacaacaatgctggcgttaaaattcatccagtcagacaagaaatcatgaatgatataaatcttaagccaaaggaattagaacgacttcaagataacgaggtaatagcaaaaactattaacaatgaaaaatatctcgtacagttagacccagaaacaaacgaattgctcaaagcaaaaatcaaaagcatttcaataccttcaaccataaaaggagttgagctgaacaagcaacaaaaggaaactctaaaatcaggcaaggaacttattttaaatgttgacaaagaaaaaatagccataagattagatttaaataatccaaaaggaataagattcttagactttgagcagcagcagaaaatagcttatgaccgacataatccacaaatcataggaactattcatactgataaaaacagaagtgaatatatagaatatatgaaaggacaaaagccgtcacttggaaatgattctctgtctaaagtagaacataaattcaaattataaaatggaagaaaagaaaaattttgaagctctgcaatatagctatgaaaatgcaggacaattccgagccatagcagcagttcttggatattcagaagaataccgaaatggcgatattaccttttccaaaggtaatgaaacatacacttatccactaaaaacacttaaacttggcaatttaggagataatagagaatccgtattagaacaatctaaagaaagaattatcagcttttttgacaaggaacaagctagcaataattttcaagaatatagccaatatttacgagaaaatcataatgtcgccatcataaaatgggatgatataaaacaaggaactaacaagaatgaaggatataaagacggatttacagtcattgaccttgaaaataaaattgcatataaaggagaagacctttatcggtatgcttatgaacaaaaccaaaccctagatggtaaaggttcatatgttgatatagactggaacaagtttaatgaagtaggagttaaaccggaaaatttaagccccgaagatgttataaacataaagaatggaaaaaaaacaggtatgctaaatttttccattgaagatactcctaataatagagaatttctaaacaatgaaaaagtttcctataaaatagaagatgggaaactcaattttgaagggaaagcaacaactcttaaatatataacagctgacaatacacctgaaaataaatctaaattaaaagcaaatgaaattgacttcaaagaagaagggaaacgcatcaaaattgatggtatcaatgctagaaagctggcgatagcagctattacagtggtttatccaatcgcagggatagccattttactcattcctaaacggcaagaaataaaaaatgatttgtcctttacaaaagatgaaataaaagctctaaaagctgataatgtcgtagtaaagactaattcaaaaggagaaagaacattacaccaacgtgataaagatactaatgagatagtatcaataaaggcaaaagatattcatattccccaaaagcttggaggaatagagttaacccctatgcagcaagaaaatctcaaaaatgggaaagaaataaccattgtaaacgaagaactgaacaaagccgcaaaagtaagactagatttgaatgccaaaaatggattatccattaaagatgcaaatgccatagaaattaaagctaccgaaaagaaagaacaaacactagggaaagaaaaacatatatctgacaaagaaagattagagtttgttgctcaaaaaggagctaaaggaattgacgaaatttttaaagacaaacctactgaaatggctgcctttttagaaaaatataagctatctaaagattatgcttcttacaaggaagtagaaaaaacatattccaactctaaggaagctacaaaacaaactatcggagaacaaatatctacccaaatggataaaatagatagttctattaaagcaactgcgaagcaagaagcatctattctcggatatggcagaacctatgggaaaaataatgatacaccaacaatgaaactataatattatgctaacatttgacgattataaggctaaaatatccatcattcaaattcttgaagatttagggtataaacaagatattagcaaaggaaagatttcgcctgtttttaaactaacagacggaacaggtaacaagttggatgaaatcattatcaagaatccccatagtgtacaagagcattattatgataggaactataaaggtggagatttaatccagttcatcaaaaatcatattaatgacttcccacaattccaacatcaaaatacatttgtgcgaattaatatgattctaggacattacgctaatgagccttatactcctaaatatgaagcattcaaaacagtaaaaacagagaataaatctttcgatagagatagatacaaagaatttcctactacaattgctgatttaagatttcttacgaatgaaagaaatatcaatcatcaggtagtagaaaagtttctcccatttataacaagggttaaagacttacagggaaacggcaattactataatataggtttcccctatattaatccaacagataaagacaacaaagtaacgaattacgaattacgaaactatggattcaaaggaatggcagccgggggagataaaagtaactcgctctggattgctgatttttgcccacatccacagatggcaaaacatatatattttgcagaatccgctttagatgctatgagtttctatcaactcaatgccaataaaatcaaattagaagaaagtgtgttttgcagcgtaggaggatacatttcacctaatcaaataaaaaacactctatcacgatatccacaagctaaagtacacacctgttttgataatgatttaaatggcaatctgtatgacattaaagtacatggaatcattagcaattcagaaatagcaataaaagaaaataaagacgatgtgctttttaagactaaaggcagggaatttagtattaacaaaaatgacatttcactagaaagttttagagaaaaaagcaaaatagtagctcccatgatttctcataaagcagaaaaggctaaagatttcaatgaaattctaatgaaacagcatgagcaaaaaaaaagtattaagttatgaatagaacaagcatagcttctgatgatattatattaaagcccaaattccgatattggttgatgaaaaatttccttttaatcatattagtgatttccgtattcgtctttagtaaatacattaggggacatgaattattaaagttcatcagtggaacaatattagtattattgatatttactatcttctacagatatgtttcaatgctactttgtactaaatggattataaccagagagcagataaaaatatatcaaggagtactttcaaaaaggattaactacatagaattatatcgagtatatgattatgaagaaaaacaaagtttcattcagtctttaataaataacactaatatctatatctattctggcgataaatcaacaccaaagctactgatgaacggtcttaaagccaatagtggcataattcaaatcatcagaaatagagtagaagaacaaaaaaagaaaaaaggaatatatgaatttacaaacagataatatgaaaagaatacttttatttttttccctaatgttactgttgggaaacataaaagggctggcacaatctattgttattgatccggcaatgattggaacattggtttattcccatcaggagcaacaaggcgtactgaaagacatacaaagtgaggaaactaaaatccgtaactttcaaattctaattcaacaaaaaatgagccaaattcaatccttacaggaaaagacatacaactatctttctacagttaatgctgttgtgaaaaatggaaaagatattatttatgcttcaaccttagctagagacatagctaagtatcagtccgaagcagctaaatacgcagttggagaccctaaattattaaccataattgcaaaaacagagtatgaacttatcagtaggagtgtagatttaatgatatacataaacaatatagctttgcaaggtggtgaaaaaaatcttatggataataagcaaaggatagatttatgtattcacgtggtcaatgaacttagacgaatgcgaggacttgcatacgctgtatgccgacagatgaaatccgctaaaagggctggagtactcaaaacacttgcacccggacaatttaaatatgtaaatagtggaaaacaaaaagtagataatattttaaacggtatcaaatggattagtaaaggaggatattaatggataatgatacaatcaaagatttaggcttatgccctatttgccaaaaagggcatatggtaaaaggtagtttaggatattcctgtaattacttcaaaaacatgaatgacaagtgtacatttaacatctatcattcatattggggaaaagagattacggaagaaatagccacccaattaataacaacagggaaaacagatatattccacgacttccataataaaaaaggagttcctttttctgcatatttaactatcgaaaatggaattgtcgttccttctttcgtgaatgaagtcctagaaactccatgtcctgtgtgtggtagagaaattgaaattttactaaatggatatgcttgtaaagggtattcgcaaaaggataaggacaacaacagagtttgcaacctctatatacccaaaactattgcacaaagagaaataccttcggaagcagcagaaatacttgccagtggtaaaaaaacaccgttcatgactggatttaaatcaagagaaggctatgagttttcttcacggttagttttaactgaaaatttagatatatcctttgataacacattatgtgcgtgtcctaggtgtggaggaaacttatatataaacaaaaaagcctataattgttccaattataggaatgaagccataaaatgtgattttgtcatttggcgtgaaatgtcaggacgtattataactcccgaagaagcaatagaactttgtgagaaaaaagaaacccctgtattaaccgggtttcatgataaaaacgggcaaccgatggaaagaaagcttgtactgaacgatgattttaaaataaaactaatatgaaaatagaatttataatttatagccatttttttaaagagagaggaatgaaggtaaagggtgattggaattttccgcatcttccaaggataggcgaagaaatttcacctcacattataatgtttcagaatgaatttacctatcaaaatttattagaatatctaacagatgaagctaaaagtgattttaataaattcaatgatggtgaggatgatttagaaggaaattttaaagcatgggtatatgatgttatctgtgaggtcaatatagttgaatcaatacattatagaccagatacagaagactatacccaaattattcctgaaatttgtttaagtgatttaagtcattaaatattattgatatgcaaatgaataagactgatttaatcaaaatggttgctgaaaaggcaaataaaccaacaaaagaagtagcagaaataattgatagttttttcaaagaattatctcaaaatctaagagaaaaagatgtttctataaaagattttggtactttcaaaaagattattcagccagctcggatagctagaaatccggcaactggagaacctgtagaagttccagaaaaggaagttgttaaatttaagccgtccaaaaatatactaaacatgaaatggctatgatagaaataaacatccatattcctatagatggtgtgaacaatatttctataccaatccaattacctgtagttccaagggttggagaaaagatttatctatctgacaaacaaataaataatttgataagtctattagaagaagaatattaccacaatccacaaacagaagaatggaaagaatcaataagacggttcaccaatattgaggaagtagcatataatgctgcaaatggaacgatacacattgaattatcaactatttaacagaaacgaatgctgtaaccatgctatttattttctgtatatttgcacatcgaattattaactatttaaaagaaacaatatgaaaaagtatttatcattagcaatgattggtttaagccttattttgtctggatgcagtaaagacgataacaacgaccctgatactccacctacaggagatataggaaaagtgcgttatgaagctaccgtaagcgacccagaaaacttcaagcttctaatacattatacagtaggagtagatatttcttccgaagcccccgaagaagctgccaaagaaattattgtagaaagtccatttacatttgaacaagaagccaaacaaggaacatatttatggctatctgcctaccctgtacctagagataaagaaaaccttgaaaatttacagttaccaaagaaagtagaagtaaaaatgtttattgatgataagctgcataagtctaacagtggtgaaaattatgcaatggttcaacatatattcggacaggaaaattaccagtagtagaattgataccttttctgccagtactggagagaaaccgggaaggaatttgataccgtacttttcccggttctcccggacatggacgaaaaaagaacattattatgataccaaaaaataaaaaccaataccactctcactacataaaagagtggtattttcatttgaattaataagatgaaagaccaaaaaagattattacacaagtgcctattagaagacattccagcttttgtaatatgcggaacagatatttgttccgtccaaacgatggaagcatattaccagatagcagtagaaaaaggttgcaatagcatttttttagaagacttgaaattagctatagaagatttcaaagcttttcaatgtgaggaacctgaaaaagttaaaatacccgattaaatcatggaagaaagcaaagaattacaaaaactatatggattcatgcaagcattcatttatataactgtttgcatagagattctactatttgttcattttccctttagtgaacaaattatgcccttattatcaaaaatggcaaaaattcctatctattctaatattctttatagtaaactatttacattctttattataatggttacttgcattggaacacgttcaaaaaaggatttagaattagacccgactaaacaaatcatttttcctttaatctttggattcataatgttctttggaagtatatgctttcttttctttaaagaaaaaggagaaactagtttagaatggtataatatagcttacattatactatcaataattggagcgacattaataaattcagctctagataacatttccaaacgtattaaatcaaactttatgaaagatagatttaatatagagaatgaaagctttgaacaatctaaagacaaggtagaaacagaattctctgtcaatattccgatgaagtttttctacaatagaaagtggcataatgggtggctgaatatatgtaactgttttcgtggaacttttgtaataggaacgcctggaagtggtaaatctttttctgttataaattcttttataagacaacattcagctaaaggatttgcagaagttgtttacgacttcaaatttcctgaacttgccaaaattgcatattataattatcaaaagaacaagcaattaggaaaaataccaagtaatttcaagttcaatgtcattaatttttctgatattgaatatagtagaagaataaacccattgaaacgagaatatatagaaatcctagcagatgcaacagaaacggcagaagcattatatgagagtttacaaaaaggcgacaaaggaagtggaagtaatagcgatttttttaaaacatcagcagtaaacttgttagcagcttctatttatttttggtctagatacgagaatggcaaatattcagatttaccgcatgtactagctttccttaatcaagaatatgatgtactttttaaagtcctcttttccgaacctgaattaaaatcactagtttccccatttgaagctgcatataaatcaggagcagtggaccaattagaaggacagatggcaagtctaaaagtacagttatcaagactagcaactaaagaatctttttgggtatttagtggcaatgatttcaatttaaaagtatcagataaaaaagaccctagttatcttatcattgcaaataaccctaaaacacaaagcatgaatagtgctttaaatgcacttatcattaaccgattaactagacttgtcaatacaaaaggtaactatcctacttcaatcatagtagatgaatgtcccacattatatttttatcaacttgcaacactactttctactgcacgtagcaataaggtttcaatttgtttgggattacaggaactaccgcaattagaagaacaatacggcaaagctaccgcaaaaactataacttctattataggtaacactttatccgggcaagctaaagctcctgaaactttagattggctacaaaaactatttggaaaagttaagcaagtaaaagaaggcgttactatcagaagaaacgaaacaacaattaatatgaatgaacaaatggattttgttatcccggcatccaaaatatcttcattacaagctggtacattagtagggcaagttgcattagattttggacaagaagataattttccaacagcgatgtaccattgcaaaaccaatttagatttaaaaaaaattaagaaagaagaagaagcctacaaagaactgccaaaagtatataactttgggacagcagataatagagagaaattactgcaaaaaaactttaagagaatatacgacgaagtagaaacagtaatagaacaatatgtataacattacattaccaattttaggcacaaggttaaagcaaatccgagagcatataggatattcccaagctcaattagcagaacagctaaactgtaaacaaaatgcgatttcaaatcttgaactaggaaaagggggcagcctaaaacttttatttcaagtgctgaatttttattctaactatgtttttatagatttaatatttagtgaaaagttttatctgatttctaatacagaagaagatgaagcacaaaaagccaattataattctgttataatagaaattataagacaatcagaaaaaaactatgaggatgctatgtcaaacgctaaaaaagagctagaagctaatcttcaaaaagccatcaatttattacagccttaataaaataaaagagagtattttgtactctcttttattttcaatattactttaaagaatttgtgataccgtacttttcggagttccggcactgatgggcaaacatggcatgatgaaatgataccgaattatcattcctggcacaccctgtagaacgcctttttgataccaaatacaaaaagcagccggaagccggccgcaaagaattgataccataaaacaaaaaaagaaaagtgttttctaaactagcctaaccaaaatcttttgtttcacaaaacgaccctttttctgtactaaagaaaacggttctttttttgcttaatcaaagaacttatgtcgctacggtgtttagttaaccaatcttccaaaataaacgaaactaaagatgaaataggtattttggctttagctttgagcaacccaaacacctcttttacatctgtatcaacatatagaacttccttgcaattataattttttcctttaatgtactctaataagtccgtcaaatccatttcactagagccattaaaattaaaaacttccgaagaagttgtttccatttctacatgaagtggttctttctcctcttcaacttcatatttagcttcttgaataggagcttcatttatactactcccatgcaattcttcacctcttatcattttagctatttccaaaacactagaaatgccttcattttgctttttccttaatttatcagccatctgcaaatatatacaattaatgaataactttgaaagaaatatctattaaaagaatattttattttatagctccttctcgaatgatataatcataggcattcttcaccttatcaatacactcattactgattgctaatgtatttatacgttccatagcaacagaagctggtatttcttctgtaacaaaaccaacttgcctaagaatatcaacaacctgttcttttgtttcatatcttaccgcagttctcatgttgttaggtaaaaagaatattttggcttttacattcaaatattgcaatacttggataaaaaagcctgtgctatccattgtaaatttatcgtatttaaatgggcaaattattatatccgcagctttaagaatagttcccaaagcatcatcatcaatcttaccgggcaaatctattaataaatttccttgctcaaccttagtaaaatcactaataattttagcaacattagatatatcggtttgtataacttcatatttaggttcattatcataagttgcaatatcttcttttcgtctatccgacaatgaacgctgaaaatctaaatccaatacaagaacctcttttcctttttctactagatagttggcaaattgtatgcaattagttgttttaccacaaccgcccttctgatttccgaataatattatcatatctttattgtttttattaattttgttgctgtcctcttttctttttcctattaggagatttatcttgctgtacatttatatgctggctaagaatatcacaaatagcatcaattagattaaatccccttgccagttctgaatcttgttcaacatttataccttccatcttatcaagagcaactatagtaattctatctttactatagctcttttctataagattgattcctaaatcatcagaactaacaattactttattctttttatctattagataaattaaattatcatcctcaacaaaaataatacctttttctcttaatgtagaatgcaaatctgaactatgagccaaataactatccatcatatcagaatagatggtattttttttatctatatgctcttgaatcaaaatatcatcttttttcacatgataaattctacttaacaactctgcttctttgactgtagtaacattaaatttatttgcttcatacactctgctattatatctaagttctttcaatagatttttatcaagaaccaataaagccttatcgtcaccatttataaatatcgtgccgttcatagaaaacctataaccataatccaacatcgatttcttgaaactatccattgtgttttttgttccatccttcaaaagaagattaattatgctattacaatgttctacttttgctcgtttattgggttccgctaaaagctccttcaagtccataacttccccacccttcaaaactctcttatttctatagtcaattaatgtatatccataaggtttgatatgccctattcctgtatgaaaaactaaatttataccaaacttctctttcattaaagtttgaagctccgtataggaaagtccttgcttgtatttaaataaaagagctgttatctgttttcttctatcttcatcaggtatatattgcttagctttatcttttatctgctctaattgaatcgaagcgtgtatttcaccacccttatacaatattaataatccatccttttctcttaacttccacccagattgttcaagcaacaacttatactgttgcactgtagaaaaagaaaactccatgtattttaaaatatcttccttagctttcaaagataaatctatattcattatctgatttataactttctgtgagcgtacagcttccatgttatcttttaccttctgtccgttcttctgcacacgtgtggaaacaatatgcacatgattattttctgtatcagaatgaaaatatatcatataaggattattcccataacccattttatctatatattgtaaagctacatttttcaaatcttcagccgaatattcacgacctctacaagaaatcacagcatgaaattgctttgccttgaccgcaggattagttctacaaacagattccatataggctatataatctgacttcttcaaattatctggattcatagcaaaattttctgcaacaagaagctcgctcttgccttcctcattctttcgctcattataactgattccagcgaaagaagttgctgcttttaaaactactactaccatacttctaactttacagtgcaaatatacaaacaaatattcaataaaagaatattttcatataatttattcatatattatatatatcaataatatataaatatataatattgatatatataatatttttccctaaagtttttggtatcataataatgttttctcttcgtccatgtccggcagaactcggaagtgtgcggtatcaaattctttcctagtttcctgcctgtgttcgcagaaaaggtataaattagatgaaatccttttgctgatggacgggcaattcctgaatagtgtcggtatcattccctttatggtgcagccgtctttctgtattcaggagtagagagaaacgacacaacaaactttagggaaagtacaacaatgctttatttacaactagtataatatatatatcaatattatatatacatatattatttgattgacattaacttacgccaagtaacattcaatttatcctgcataatcacatactctgccattctcttttcaacctcgttaagaatatcttgattagtttcttccttatgaatatttacatatctagccaactgatttatgttgtttcctattcgtttcatttccaaacaaatttcatccattgagcgaataaattctttagggtcaataagaccaactcctttcctaaatactctctgtctaaaatagtccgacatacatttacttgatttagaagctttagttaattcttcatattccaattttgtcaaacgaactttcacaattctatttcttttattttctttcatactatgatactaaataatatatgcccccaagttgcgagggggctaaactcctgatttatcaggcaagatttggtttttgtgtccacaaaaacacatcttgctattaatttctacaaacgcaaatatataaattcctaaacaccctgccaaacaaaagggaaaagaatacaattagataagtttttggtatcataataatgttttctcttcgtccatgtccggcagaacccggaagtgtgcggtatcaaattctttcccggtttcctgtctgtgttcgcagaaaaggtatcaattagatgttatctttttgctgatggacgggcaattcctgaatagtgtcggtatcattccctttatggtgcagccgtctttctgtattcaggagtggagagaaacgacacaacaaactttagggaaaagaaaattttcgtgtagctctttccggttttcggggaagtgtatcaatcacatattatatatccatttattcatatattatatattcatatattatttatatatataatatgatattttattcctgttctttttccctaatgttttatggtatcaattttttgcggccgacttccggcagcttttagtatttggtatcaaaaaggcgttctgcagaatgtgccaggaataataattcggtatcatttcatcatgctatgtttgcccatcagtgccagaacccggaaaggtacggtatcaattccttccctttaatatatcaaaaaagcatagggacaaaaacccaactttttaaaatatgctttttttagatagggacaaaaacccaactttcgtttgagtagttatatcacataggactttttttttgttaatggatgttcttttccctaaagtttgtgttaagaaaataagaaaagttccttttttatgggtttatgtaataagaaaaattccttttttgtgttgggtaggattatcaagttttatttaatcagctagtgatagtagtaccctaaaatattgatagataattacttaaaagtcagcacatagagataaaaagttagggacaaaaaaccaactttctagggacaaaaaaccaactttctagggacaaaaaaccaactttctagggacaaaaaaccaacttttatacccttcatagggacaaaaaaccaacttttattcattttctttttcttctcctattattccgggaagcgtttctacctcttttaatagaaccgccaaacaatattcggctttatttgaaatcttattccaattctctctaatatattcgcctaaataaagcatcttatttaacactgctacatgattattcaaggtgatatgtggaataaactgctgtaaatgttcgtcctgcattgcaaaatgcaacgtacaaaagttcgttatcatcttcttttgtccttttaacaaatcttcttccttctttgataatgcagatttaataaccttgaaattaagtttatagggttggctatctcctgaattacgataaacttctgccatttcaaaccaacaatcagcctgttcaaacaaatcatcgtaaacaggacgtattacacgtttatacaaatctttaaattcggggtatttatcctctagttttaagaatttcctaaatctatccacataaatagaaaaaccacctttttctttccatgagctaatcaacatatacattctaatcgtatatctactttgtgctcttaaagctatttcttttatataacgcgtaaaacctctatcaacatttataaaaactttagctacctctctatccatttccaaagagaaccctcttgaataaggagttttaggaatattagcctttgtgaataaacctgttatagcccaactttcttcacctgttatcgggtctttaacgtcaaactctacaggaatactgattaatttacgaaccatactttttacttctttgtattggtctggactaacacccaaatcccggtaggcaatatctactcttatacggtccgaatattcttgaaataaggataattgctcacatggaatagatgtaccatatttatctagatgctgaatacttaattctatgacattctgtaatttttctataacagcaattaagattctaatctgtactgtcttgaaatcaccagccattaatgtaaccacattaggctgtttcaaccatgtgggattttcaggaagttctaccggaagatttgtacgaggatgcccttttctaattctaactatctcaccgtctatttcttctttttcttctttaaccgcacgttttcgaacttttatttctctatttaccatcgtttattattttgactgattaatacaccaaaaaaaagtagaatgaagaacataaacataaatttggctatataaaatatccctatgaaaatcattctaaaaatagtaatgataactcctaataaatttcttattatgttcctccaatccattttccctatttctataattcctgtcgccaaagctccggctgcactattgtataaccagcactttgcaaatatactcttttaaattcatcgggcaacgctccttcaaggaactgctttttatgcctagatgcagtccggcggtcatatggactatttttagcccaacctcttttaaggattaattccttaaagcattcatctaatgtttttgctttatctatcataatcttttcgtaaagaaattatcggatttttcaatcctttatacatttcacaaggagttcctaacaattcacatataacaaaatgtataattttctcttcatccaataatggatttgacttattctctagttccacaactaatgtatattgataattataattctcaacaacaacttctttttcattagaaacctcattgtaaatctttctatatttatgccataaagatgtattaaaaagctctacagtaagataattatttatctgttctgttgtatagtcttctgacaaacgttttccagtaagcctataaacagcctctattttcgcttttttccctacaaactttttctttcccattatctgacaagaagaaatcccatccctagatataaaaggcttcaaatctgacatcttacgatataccttatattcaataaacattctatctatattttgattatatgacatctattccatttaacacaattcgataaaattatagtcatttatcccaatcgtaattatcataatctatctcctttcccttggcatggcattcagctacataatcagcccatttctttcttttcgtcacatcaaagggcatacgtagaaactcatctttccaaggctgtataaagtaatcaaaatcgtgtttgttggtcacgtactgaacggcatctctaataccattatactcatattgttcttgtgacaatggttcatcacctagttgggaatagatgtttgccacctctcgaagcatcttgccaaattctttgtatgtggcaaaattcttttcttttttatccatgatagttcctttctgttcagttatgaattaaatttctcttctatatcttgataatctatacagcttataggaatacataaatcaggttcttctaatttgatgtcaggtccataacattctatctttttagcacaattaatacagagatattcttcattttccataatgttccatctttttgctcattttgatttgaattattttagaatatcatcaatagatgataagacactttctaagtgctcggattgttcgaggtatttcatccgaagattttcctctctgttggttgcctctcctccagaatgaatatcatcatacttttcgtattttgacttcacttctttatatgctttctgaaagaacggaagtaatatcttacattcctctttagtcatacaaacggttatttcgcatgctgacgaaagtgattttcgtgtattatctatatagctcatatttatttagttttgagtgttactttttttcgatgaaagtattggttgtattcaacactccggctgaatctcgacttttaccatctcttatgaagattccttcttcttttaaccgttcataatcaagttcattcatcatgataatgacaatgttttcatctgtatatagcttacacttcataaattgagtaccttctattttcccaattacgtctatttggatttttctattcataattcgttcatttatgttctagttttgaagtaccattaatataactacgcccagcatcagttggacgataaacaacatcgccaaatggtccagatgattttgtcaacaaaccgttttttaccatttcttctaaatcatcggaaggctcactatatcccccccatccttttttgcagatattgcctaaatgaataagctgcatcttacttaattttatattcatttggttcatctttattatagttttgaatcagaaatcttagagagttaatttatgtatatttctgtaaatatattaccttagagttacttttgtacaaaatgttggtgataccccataattgactattaatctgtagctttcttcaatgcttcaaaagaagacaagtaatcattaacagcttcatttaacgtagtatatttatctttccacgctcctttttgccgttgtgtttcaatatacctatcatttaattttgcataattctgaatagcaaatctaatggctttagcatccgttttttcaccagataactttttcagattttccaactccgcacaagccgcatcatccaaacgtaatgtaaactcttttttcataaaaaaatgatttaatactgaaaaataaccctaatagttggctatgaaatggatttaagaagtaatatttcataattttgtttgctgttctttatactggcagccaaaccagctttaaaggtttgtttatctctttattttcaatactcaaagatagtgattttctataaatgtcgcaaataataagacaattatttttgttaaaaatagtttctgatttacagattgccgaaattttcttttccctaaagtttttggtatcataataatgttttctcttcgtccatgtccggcagaactcggaagtgtgcggtatcaaattctttcccggtttcctgcctgtgttcgcagaaaaggtataaattagatgaaatccttttgctgatggacgggcaattcctgaatagtgtcggtatcattccctttatggtgcagccgtctttctgtattcaggagtggaaagaaacgacacaacaaactttagggaaaagaaaattttcgtgtagctctttccggttttcggggaagtgtatcaatcacatattatatatccatttattcatatattatatattatatattatatattatatattcatatattcatatattcatatattcatatattatttatatataatatgatattttattcctgttctttttccctaatgttttatggtatcaattttttgcggccgacttccggcagcttttagtatttggtatcaaaaaggcgttctacagggtgtgccaggaatgataattcggtatcatttcatcatgctatgtttgcccatcagtgccggaactctgaaaagtacggtatcaatttctttccctatagttcttattgggttaaagaaacataccttagaagggtgggtgggtttactgatagcaaaactattggagcgtaacaaagtgaagcgattaagcctttttggttcttttttggcgtttgaaaaaagaactccccccaatgaggggggaaggaacctttaagcaacctttgtatttttctcttcatcaacttcttccacatctagccttatatttagatgctgggctatgaatttactacctttaatagcatctgccaatacagtaaataaaaatttaggttcttcttttattgctttgcaccatgattttaaataagccgcattttcttctctgacggttacagaaatacccaaatatacaccagacaaagccgatattaattctgctacaagttcttcacgcccataattgaatttatcattttcataaaatccttttcgatttagtctatttttaacacctgtactatgtcccatttcatgtaattctgtaccataaaaactttctccgtccttaaattggctctttaaaggtaaagtaatgctatcatttgatattgaataaaacgcactatcactaaaaaccgtttgaataggacatacccaattttgattcttattcatttcatcaagtattggatttacatacatttctttctcttcttgtggctgttcctctcctgaaaatttagcctttaatatatcccatctattgggatatttttccgcaaagtttgtttggtctaaattaaaaacttggaaatattttgtataagctgctaaacggtattctttttgttcttcttctgataatttgttatattcatcacatgaaattttttcatttgtctgacgatgataagcacaaaataatgtataataaacaggaaaagcaacagcaccttttagaacattaataccttcgtttcgtgcttgattgaatgtcaaaaaaacaggagtttgataattatatttttcacacaaaaaataaagtaaaaaagcgtttccaccactataagtacgacctgttaaattttgtggtaaaaagttctgtttagagttgactttagagaaccaaggtttttgccaattcatagacaaactttcaattttttcaaccataaggtttacaaacttctctgcatttttatcaaaagtagatttcataattttgtttgctgttctttatactggcagccaaaccagctttaaaagtttatttatctctttattttcaatactcaaagatagtgattttctataaatgtcgcaaataataagacaattatttttgttaaaaatagtttataactggctgatttttaacgtattatcttttccctaaagttttatatattttgggtgagagataaggttttataaacggaatattccctttagggaacatgaagtctataaaaccgaatatccaatgccttgcttttgtaggtgcttcatagaagcggtgaaaaaagcaaagcattggatataccttagaagggtgggtgggaaaatgcgttagggattgcagcggaaagcccacagcgtagcgaggacttgcagcgaaaagcccgacctgaaaggtaacgccctatttatttcttctattcatcaatcttactttttcataacgtaaatacctatacaaagtagccttacttccaatgtgtaaaattctacatatttcatctatagaataatcccgattttcatataaacgctttgctgctatagcttttctctttgcatcttccgataaccctataggtcgtcccgtaagtttccctcgttcttttgcagcttgtaatccagccctagttcgttctactattatttcacgttcatattcagccaatgaagcaaaaattccaaattgacatcttcctaaagcactattagtatcaataccatcaactatgcttttgaatgcaacttttcttttctgcaaacaatcaactatataaactaaatctttcaaagaacgtcctaatctatctagcttccagataacaaaagtatcaccttctcgcaaatatgcaagggctttatctaattcgggtctatcctttactcctgatactttttcctcaaatataagtttgcatccggcttcttttaaagcatctagctgcaaatctaaattctgttccctcgttgaaacacgagcgtagcctattatctccattttatttaaatccaagtttcataaattcaactattcgcgaaactattttaaactagggctttttcccctgttattacctctagtactattataaatcaaaagtacagaaaaagggtcgattaatgaaacttttaaatttaagaatatgagttattcacaatttatcatggctgtatttgccatttatgtagtttactacgctgcaaacatcctgtatgatgctttcctaaagcaaagcaaaaccaatacaggtgaagaagaagaaattatttcaataggagaggaagaagaaatacctcacaaagttgtagatgaagattttgaaacaggctcatacgaaaaagaggatgaaaaaaaagaatctgaacagaattatgtatctgtaaatgaatctattgaaatggaagttgaaacacaaggtattccaatggaacaacttcttgctaaagggaaaagcatgttttcacacgtaaattttaacaaataaacaactaatttttattcaaatgaaaaagtttttttcaaaaattgctcaaagagcattcgctttagccattagcataatggtagtaactaacacttttgcacaaggtgctgcgggaattgatgcagctagttctgaacttgcaacctacatggaccccctaggaaacatgatgatgatactaggaggtataataggattaattggggcagtgcgagtttatttaaaatggaactctggtgaccaagatgtacaaaaggctgttatgggctggatggggtcatgtatcttcctcgttgtatcaggtgttgtcgtaaaagcattcttcggaatctaatatgtcaaaagagcatcttagttacaatgtatataaggggctacaaaagccccttattttcaaaggatttaaaggcaagttcatttatatcggtggagcttgtattattagtgctttacttttatgtgctattgtttctactctggcttcttttatgtggggaggtataactcttgtaatagttatgtttggagggttaggaataacatcgcaattacaaagaaaagggcttcacaagaaagataaacgaaaaggcatatatatagtatcacgcacttttgtaagagatagaaaaaaataaagcttatgaaaaagaaaagtgaatttgaagctccttatattggtattgaaacaatagacaatactcctatattttataaccgaaggggcgactattctgttatcattaaatgtgaaaatcctataatacagtattcagcagatatggatgcttactatgattttcaccacttatttactaatatcctcaaagtattaggaactggatatacaatacaaaaacaggatattctatgtaaaaaatcatttttaccaccccagaataggaagaacgactatttatcaaatcgttattttgaacattttaaaggacgaatatatactgatatttctacttatcttgttattacaggagaagtagaaaggtctaaattcttttcttttgaccctcgaaggtttgatacttttattagaaacatcacaaaagtattaggactattcgctaatagaggaataagagctaaactattaaatgaaaatgaaatagaaatatatataaaaagatttctatctatcaatttcaatcagcaaacagtaagcctaaaaaatatcaaagcaagagaagaaaatcttataattggagaaaaaaacgtacagtgcatttctcttgtagatattgacgaagttaattttccttctattataaaaccatataaagaggtcaatattgggctaagatttcctgttgacttactctcttttttgcatgatacaccaagtatagacacaattatctataatcaagtaataaatattccagaccaacgaaacgaagcaaacaaattagaaggcaaaaagaaaaaacataaaggaatgcctgaccctgcaaatgatttatgtgtagaagatatagaacgagtgcagtcggatatcgccagagaagggcaaatgcttgtatatgcacattataatataattcttgctggtcttgatgatattagtaaggctgtcaactatgttgaaacatctctttttgattgtggtattattgtgaataaacaatgtttcaaccaattagaattatttgaatgtgcactgccgggaaacgcaatcaacctaaacagttatgacaaatttctaacaacttccgatgctgcaatttgtcttttatttaaggaaaaattacaagtaacagaaaacagcccttttcttacttattttacagacagacaaggattgcctgttggaatagatatgtccgggaaagaaggtgagaaaaaatatacaaataactccaacttctttgttttaggtccaagtggttctggtaagtctttctatgtcaactctaaagtaagacaatgggttttagatgatacagatattgttttagtggatacagggcatagttattcaggaatatgcgaatattatcatggcaaatacattacttattcagaaagcaagccaatatctatgaatcctttccgaattacagaagaagaatataatgtagaaaagaaaaactttctcaaatcattaatttttctgatatggaaaggtgcaaatggcgaagtcaaaaagcaggaagaagaaataatggatattaccatagaaaaatactattcattctactttcatcctttcaacggctattcagatgcagaaaaagaagccatacgtgaaaatttgctacttgaatttcaagtcaacgcagaagaatttgaaaacgaaagggaaaaagaagaacgtaagatactttctgaaaaaatagataaattgcaacaattggtagaaaaaggagaaggtggagaaaaaactaacgcagaaagagcgatacaaaacattctcattgaaaaaggcttcacacgccaagagcttgataatcctgaaaccagattgctttctgtcatagaaagacgcatccaaaagaaagaagatatactgaaagaaataaaagttgaaagtttatcttttaactcattctatgaattttctctacgcattatacctatcatttgcaaagagaacaagattgattttgacattactaactataagtttctactaaaaaaattctacaaaggaggacagttagaaaaaactcttaatgaagattttgatacttccctctttgaagaaccctttatagtttttgaaattgatgcgattaaagatgaccctgaactattcccaatagttaccttaattattatggacgtttttatccaaaaaatgcgattaaaaaagaacagaaaggcattaataattgaagaagcttggaaggccatagccagccctatgatggcaggatacatactctatttgtataaaacagtacgcaaattttggggtatggcaatggttgttactcaggaactggaagacataattagtaatccagtagtcaaaaactctattatcagcaactctgatattatatgtctgttagaccaaagtaaatttatagacaaatatcaagaaatcgccaatcttttatccttaacggaagtaaatcaaaaacaaatatttactatcaatcaacttcccaataaggaaaatcgaaatcggttcaacgaagtttttataaaaagaggtaactatggtaatgtatttggagtagaggtttctttacacgaatattttacatttactacagaaagaatcgagaaagatgctgttggatattatcatatcatttacgatagttttcaaacagggttggataattttataatagacctaaaagcttccaaattaaaaaatacggattgggttttacaagtcaataaggtactagggtatcactccgatgaaggaaacttaaaagatatacttaacatcatagggcaacagccattatataagtatatcccagataaatacaaatggcttacaaaccgttaaagataaatgtcatgacaaagatcctatttattttagtggtagcatccactttaacccaatttgcatattcgcaaaaggcagtattggatataacctgcatggaaacacttatagctaatcataaggtgcaacatacttctttctctaaagtgaaagataatgaaactcaaataagccttatacaaaagcaaatcagtgaaaaaatggttcagattgaatttttccaaagcaaattttacaatagcctaaaatctgtagaagccatcataaaaacaggaaaagatattatctactgcactgatattgcagcagatattggaaaatatcaaaaacaaatggttgaacttgctgtaggtgacccggctttattattggtgtcagcaaaaacacaattagaattagttaatcgtactgcggatttgacacaatacatttatcaggtcgccattgtcgggactgatgtaaaccttatggataataagcaaagaatagacttgcttaagtatgttattaatgaactaagaaacatgagaggtattgcatactctgtatgccgacaaatgagaacagcaaaaagaaatggagtattacaaacattagctccgggagtatttaaatacaaagacaatcgttcaaaattagttgatgatttattacagaattataaagtaaacgcagaaagaaaaagcaaggttgatgataatacagcaaaaatgcagtctattaagtggttaggtgtttaactcataatactgcataagctgaaaaaggaggtccgataaaagctgcgaaagacttcagttcccatatcgttactgatataacaggaacaagaaacggcacaacagattctatttcagtaatttgcacagtttttcatacctgaggacaactcgcttgatattaactttgtaacgatcaaaaaagtatgaaaacgagtatgagcagatcgaccttcaaaatcctcttctacgtgaagaagggcagcgagagagccaacggctatctccccctgatgtgccgtcttacggtagacggcgaaatcaagcagttcagctgcaagctggacgtgcccccgaaactttgggacgtgaaaacggcacgtgccacgggcaagagcgccgaggcgcagaaaatcaatgcggcggttgaccggatacgcgtggacgtgaaccgccgttaccaggaactgatgcagtccgacggctatgtcaccgccgccaggctgagggacgcctgcctcgggctgggcgtgaaacgcgagacgctgctgaagctcttcgagcagcacaacgaggagttcatcaagaaagtgggacacagccgcgtgcagggaacatacaaccgctaccgtaccatatacaggcacctttgcgagttcgtcccgaaagtataccgccgtgacgacatccccctgaaggaactcaacctgaccttcatcaacaacttcgagtatttcctgcgtacggagaagaaatgccgcaccaataccgtatggggttacatgatcgggctcaagcacgtcatctccatcgcccgcaacagcggtgcgcttcccttcaaccccttcgccgggtacatcaattcccccgagagcgttgaccgaggctacctgacggagcgtgagatacagacgttgatggagaccccggtgaaaagcgggacctgcgaactggtacgcgacctcttcatcttctctgtgttcaccggactggcatacgcggacgtgaaggcactgacgaccgaccggctccagaccttcttcgacggcaacctctggatcatcacccgccgtcgcaagacaaacaccgagtccaacatccgcctgctggacgtgcccaagcgcatcatagagaagtataagggactgtccaaggacggtcatgtatttccggtaccgagcaacggcagatgcaacaccatattgaaggaacttggcaggcagtgcggtttcaagatacggctgacctatcatgtggcccggcatacgaacgccaccaccgtgctgctctcgcacggtgtacccatcgagaccgtaagccgtcttttggggcatacggatttgaaaaccacccagatatatgcccggataaccaaccagaagatcagcagcgacatggaaatcctgtcccataagctggaaaagatggagaaggaaatatgcgatgccatctgaggaaatggtatttatgaaacggatgattttccccttcctcatcaaagttcgtccgtccctgcgggactccgcgttttcccttcggtttccggcagaaaatttccgtacggcgaaattttctgccggaaaaacgctccgaaagcgcagggacggacgtaagagggattcagaaggcgaaaactgcgaccgacgtagtgcatgtgcgacaaggaaaagaactgtccgggagcccccttttcatgccgtaccccggcatgaaaccacttttctctccggctgtggtgaaggctctcctgctccctctgcattgcatatgcgggttgttttgcccatatccacgtccgccggtattgcctgccctttccttgagaaaaacggcttaccgcaacgggtggcgtgacacagacttttccggatatggaggaacattccggaaaaaagagtggaagacgggctattatttggctgtataacaacaaagttgtatttttgcaaaaaataatattatggctataactatcaagaacattccggttttggagggcgttacggcggaagatttcgtacgcagtgcagacaagaacgccgcaaaggtaacaccccggttatcagtggaggcaaagaaacggttgcgaaaagtattggagaaatcccgttcattccggttcaattaacagcaatggacggtatttctttatatgatgattgtgtcatgcttgcctataacaaggaagtacggaggaattgccttcctttcacttgtggcgagaatgaccttgatgatttttttctcaatgatgccgatctgtatgcggatgaactccttgggaaaacatattgttgggtgacgactgaaatcccgcatcgtattgtggccttgtttaccttgtccaatgacagtatcaagaccagattaatatcccccaatgataaaaacaggctgcaacgcaatattgtaaatcctaaacgtggacgcagctatccggccgtgctgataggaagactgggggtcaacctggaatatcagggtacatcaagccacgtaggacggcaactgatggctttcataaaagactggttccgtcatgaggacaacaagacaggatgccgttttatcgtggtggatgcatacaatgaggaaaagattctcaggtattatgaaagaaacggtttcgttccactctataaaacagacgtgatagaaaagcaatattatgatattccgcaagatgaacctttgaaaacccgtttgctgtattttgatttgaaaaaggactgacataataatatatcagtaaaatcctttagggtgacaacgggttccaaagacaggctgtcgctacgattacctgccatatggcaccggccgttttcttgatggcgggcggtggatttcatgggaagccaatccggaatgacaagtaatgccgcacctgtggcataatagagcattattttgaaggcggagactttgtccggttcttctttttccaaggttttccgtcggatgtcttcaagttttccacacttgttttagaatagtccgcattatcagcagattgcgagtttcagtctgccgttccgattctctttattgcatcgtagcatgtcgttgatatattccaaatacttatccatgaataggcgacttataattttgtctcaggcaaatatcgagacacactcccgaatgaggtcttccatgattttaaaagactccgtatttcggaaggaacaacgtacacatacaatttctccggaacggccgactttcctgtcacttccctgtaatcctccccaaaatcaacaccgccgtataaactgcatgaaagcccgggcacgcttcctgtttccaatcccatatctgctccttccgcaacatcacgtattgccgttctcatttcatatccttgaatatttctccaaacataccaaagacagaaaagctgcatggaatctaaattctcaccggacagacaatagatagaaggaaggaatccatcatcctcatttcttgcggcaaaaatagttgtttttcaggccggtcccgcaaggcggcccttcgggctggttgcacgtgaaaaaatcttcctcacgcttcgcgtgagcgtattttttcacggcaagccttgccggagaccgccgaaaaacaaactggaggaagcacaagaaataagaatgcctacccgtgtaggccatgtataactcaaaaaaatataaagctatggcagacaagagcgcagaaaaggaaagactgttcaacgagtggttcactgcatcctatgacaggttgagagggacgttacgccggtacggaatgctggacgaggacaatttccatgacacctacctttttgtaagaaggcaggtgctggttcccggaaaggacataacggactatgacgcgtatttcatcggatgctacaaaaaggcggccctggtaaagattaaaagggagaatcggtatgcacaccctgaagatgatttcttcctccgatgtggcgaagaggcaaaattcctttccgaggacgacctgaacgggtgcgagcggctggtaagagacatactgcgtttcgtaaggcagaagttctcctacgaggagtaccggatgttcatgctcaggttctatgaggcgcagttctcgttcaaggcactggcggaatgcatgggtatctcggcatcggccatatcgcagaaagtatgcaggatagtggacgcggtacgtacccacagcggtttcgcatggagaagtcagatgctggcggtggaaagcttcatgtattgaaaaaattgtttaacggaaaagtaagaaagttatggcactgatagtatacaacagggaaaactcccgtccgcaggaagtcacatacaagggaaagcggaccatcaaccttgacagcagggggaccgtctatctgtcaaagacgatgtcaatcgaattgggaatcctcggtggcggacgggtgaacttcgcccacgacgacgagacggatgactggtacatctgccgggccgatgacagcgaggggttcattgtctggaaggataaaagatgcgcaaggttctcggcggggtttatcgtgcagagactcatgcggcaggcgaaggtggagaggaagagcgtgcagttcatgatggcgaggatgccggtagagattggcggagtggcctattacaagatactgctctcgaatccgatactcagatagaggcatgggccggaggagtccggctgtatatgacatgacggagacaggtgcatccgacgggacaggagcccggaggatgtgcctgtttttatgcgccgccatgtttacacacggacatgcggttgtcaccggccggcataaggtcactccgaaaagaccgggaaacggcattgccggaggataatgataccagtacggaatgtgccgccattacggaaacggatcgtcccaccggtacacgaacggcccgccccaatttcagaataacataatgacataataaaataagagtctttttttataatggaatccccgtatcttattgccatatcggaaaaatgtttccatgtcccgccatgttatgccaatgttgtcaccggatcataattcataaagaaaaaaacactctgtgtataagtattttacgagcaaattaaagtcgttcatccggtggaaagaaaatgaaggagcgaccggtatgacaaccgaccgccccttcattcacgatcccgtacggaacttttctaaagttcctccggcctggttctcgcctcccggtagcagccgtcaagcagcttctcgatgtcggaagaacggtacagtatcttgccgcccagccgggtgaaggcaagcagaccgctgtcacggtactgttgcaggctgcggcggctcactttcagcttttcagccagttcgcggtccgtatagaagttctcgcccgccatcgccggtgacctgccggcaaagagacgctccatggaaacggagagacgttcgacggtggagaagaactctcttatatgctcgctgctctcacgggtgagcagacggttatcggtattcatcatgacttgatcttttttttgttcgacattcgtttttcatggcctttcagatcgaccttcccatactttcagcccgcttgcggcgctcctccactatccggatgatactttccacgtccccgggcttgtaatatgtcttgtggcagatctgtgtgtatgccagcgtgccgttgtcacggagggtctgcagggttctcgggctgaccttcagcagcaggcacacctcctggttgtccagccatttcttctcctccatgtcgccgtacagccggcagagggtgtccagccggtccgcaaacgtccggaaggccgagagcatcgcctcgaaggtccttgcctcaatgttcactatttccataatcactgtaatttcaggtttgacatctgtttcattctcttttcggatccggattccgttccgcaatttagtgaatcccggcggaacgtcctgaatttcaagacaggatgactacctttgacaccatatgcgtacttgtttcatctgcaaagtaaatgattgttcccggatatggttccgccccttcatcagatgtcattatatgtcatcagatgtcatggaaatcggattttaatattcatttgcttttagtaaacagacgttcagatccgttcccgaagagtgggaaatttccggtgcgtatatttgtgaagtcatcaccgtcagactgatccaacaatatgaataacacggcaaaccccgccaatcggacccggccgtttcacagcacttgttattatcgttttatttgcttccgacaatcgggcaaacgggtagaccgtgcccacagtatcaaccatctaaaatccatgtacaatgaaaagtgaaccgactgaaaaaacgaaagggaagaaaatggcggtatccgaaaccgcagacagaaagaacggccgtagtcccggagccggccacgacgagtggtgggaaagactcatgatggaacccggtccgggggaatccgccggtacggatgcttccgtgacggaatcgatgattccatccgggctcgttgcggaggaggtatccggggaggcgagaagaaaggacaccccgccggaaccggaagaccccgtgagaagaagaacgagcggcaggcaacgcagggcctcgctggaggagtaccgggaaacgtacctcaccgtcccgaagatcaggaaccgcaagacggtgttcgtcagtgaggatgtgagggacgaactggacgccgtcgtccgcaggctcggcgggcgtggcatgagcgtttccggactgctggagaaccttgccagggagcatcttgccgcctaccgtggggacatcgagcagtggagaaaaatctgacagcctgttaccgggcgtggagtatacccgatgtatgcactgttccctgtatacccgcttcaatgtggaaaatgcgggggggggatttttctgtggggggagcaagggtatgtttccggattcccgaaaacccttgctccccgcgcccggcggttgctgggagggcaaatccgctcccgccggtcgcagattttggaatgaaagaagtacggacgaaaaagaaaaaacatatgacaaacgatgtgaatgggatgaagaaaaaatgtggccgtccggcactgggcaggacgcgtaaattgaccagaggcgtgacggtgaagttctcccccgtcagctacgaggctctcaggttcagggcagggaagtccggccggagtctggcggtctatatcagggaggcagcactggcggccaccgttacggcaaggcatacaccggaggagaacgcactgttgcgcagcctggcgggaatggcgaacaacctgaaccagctgacaaagctctcgcaccagaccggcttttacaggacaaggctgctgatagaggggctgctgggaaagctgaagcggatcatggatgattacaggccgaaaggaggatagcctcatgatagggaagatcaggaaaggccgctcgttcagcggctgcatacgctacgtgacgcagaaggacgacgcaaaaatcatcgcctcggaaggcgtgctgctgggaacggtggaggagacggcacgcagtttccggtggcaatgcctgctgaatccggacgtggcgaaaccggtggggcacattgcgctcagcttcaagccggaggacgcaccgaggctgaccgacgcgttcatggcaaggctggcggaggaatacctggagctgatggggatacggaacacgcagttcatcgtggtgaggcatcacgggacggacaacccgcactgccacatcgtcttcaaccgggtgaacttcgacgggaaggtgatttccgacagcaacgatttcaagcgcaacgagaaagtgacaaaaatgcttaaggacaagtattcgctcacctattccgaaggcaaacagtccgttaaaacggaaaagctgcatgcttccgaaaaggtgaaatacgaaatataccgtgcggtcaaggaagctttgaggagtgcagatacatggaaagaatttcaaaataagctcttaaaaatgggcgtggaaatggaattcaagtacaaggaaaacactaatgaagtgcagggcatccgctttataaagaacggtctgtcattcaagggaagtgggattgaccgcagtttcagctggtcaaggctggatgcggcattggaccataaccatgtcacgtccctggaaaatgacgtttcccaaaagcaaccgtaccatgaacaaagtcatggttctgttattgataacctggtcgaagtcaccggtacgggtggcgtgttcatgccgtcggtggcaccgacggaggacgagaaagaggcggaacgcctgcggagaaagaagaagcgcaggaaaggaaggagtttgtgaaccatatgtataacaaaaaactttgaaagatgaaagaggaaaattatctggaaggcatctacggatgccttgaaaggatcgagaagaaagtggagacgctgcccgtggaaggcacaagccccgcagttggaaaccggaccagttccccggaagggattgcggaactgaaaatccgtctggaacgcctgcaatccgcggtggagaaaaacggcttggaaatagcagcggtacgtaaccataccgtccggttgtcggaaggctggccgttgtctgccgaaacgtttgccggggagatggaaaagattagatactgcctgagtcaagactgccaagctgtaaaggagacagtgagacggctggatgagagaatggtcctgctgaaaaaggaaccggagcgcagactggtgacctaccgtctggaaagcgcatccaaggcagtggtaacgacagcttcagcactgatcctggcactgatcatttccgtctggaccaactgcaaccagtaccgcacgaaccggcttttgaaagatgccgatttgaaataccgagccatcaggatctgcctgccgggggatgatcccgacatcgccttccttgagaagcatttcaccatcaagcgggacgaggaaaagatccggcgtgtggaaaggctggtgaccgcttttgaggactcggtcaggaaccgcatccgtaaccatgaaatggcagcctacaaggacagtctggcgcaccggctgttcagggaggcacaggaaatcaggaagcaactggacaatcccaattcaaaatgactgcactatggcaacaatcagaaccaaattcaggtcctcgtccgcggaaggcagggagggcgcactgtattatcaggtgattcataaccgtgtggtcaggcagatcagtaccggatacaaacttttcgcttcggaatgggaccaacgttccgaagcggtcattccctgtcaacatcctgcagggatggaacgggacaattatcttctatcggtaggggaacggataagacgggacaaaatccgactggaaaaggctatcaggacattaagccaatccggtccgtttacagcggatgatatcgtcatacgtttccatgacagcggacaagaaccttcgtttaacgactatatccggcaacagatagtaaggctgaaacgtttgggaaagatacggacctctgaaacctatacagccgcgctcaaaagtttcagcagttttatgaaaggtagcgatatactgtttggcgaacttagctctgacttgctcatggaatacgaggcttatctgaaaaacagggggaactcacccaatacaatctcgttctacatgcgcattctgaaagcggtctacaaccgtgcggtggagaacggactgaccggacagcggaacctgttcaagtctgtttatacaggtgtggaaaagaccttgaaacgggccattcatttaaatgatatcaggcgtatcaaaagactggacttgtccctgaaaccccaccttgatttcgcacgtgacatgttcctgttctgcttttacacacgggggatgtcctttgtggacatggcttatctgaaaaagggagacattgcgaacggaatcctgacttaccgcaggaaaaagaccggacaacagctgttcatccgatgggaaaagtgtatgcaggagatcatcaaacttttttgtttatcggttcaagatttcaaagttgttcattaattgctttgttggttatatccagagtattatttgtaagagactctacgaataaatgatgataagaccagttagtttatcgcttgttttataatttcattgcgatattcgttcggtgtgcaaccttccatcttcttgaaccaacgtgtgaaatgttgcgggtattggaaacccatttcatctgagatttgactgatacttttttgcgtgttcatgatgcgctctttggctatatccataattttttgctggatatgcttgattgctgacataccggtttccttttttaccaggtcactgaaataattggtggaaagacacagttggtcagcgcaatactgtaccgtcggaatacctttactcgttggcaaggcagaatgatagtaattattgagcaacaattcaaaacgcgccaacaaatcgttgttggcattttcccttgtaatgaactggcggtcataaaagcggatgcagcggtcaaagagaagcttcatggtatcaataatcaaagaacggctgtgcttgtcaataggatgcctcaattcttctgctacattgtttatacattcaatgactactttgcgctcctgttctgacaggtgcagtgcttcgttggcattatatgagaaataagaatactcttttattatatgtgcaagggaagtaccgcgcaatagttcgggatggaacatcagggcccatccggccggctggtgcagactgccatcatcgtcagaacccattacctgccccggagcgataaacagcatggagcctttttcatagtcatagaggctccgtccataattcatcgtaccgcagtcagtatctttcagcaacacagcataaatgttgtacagtttctttgagtgtctgatgggctgcacctcgtaacaattcacaacgctgaccaacgggtgcagagcttcgacttcgaaaaggtcgcagtactgctgaactgtatctattcttgttatatctcccataaccatccttttgttttttacaaaaataagtatttatattgacattgctgtctgaggaacagctgtttcttttctatcccttatttattttattccatgacgacaaagttagttcattcaatcaacgaacatataaccctaatcacagactgtcttaccattttcacagataacatttaacccggtccaagcccgatgaaagtggtaattttatcagtgattgaggtctaatcttcagtatgtgaatgctgtaattttgcaagtgaaaccaaaaaggtaaataagatgaaaccaaaagctttatttgtcatgttaatcttatggcttagcttcactacgattcaagcgcggtcaaccgaagatgtcccggataagggaacttatgcaaaatttctgttggtaggatgttatatgaagtcagacgaagaaggtgtcagaatgtaccggtttgacggacaaactgccgatgtcgactatccgtgtgggctgagagggatttcaaatcctgctttccttacatctgatagcactggtaatcgaatttatgccataggcgatgatgaagggaaaagttcgactgccaatgctttgctttttgataaggaaagtggtctgctgtctctgcttaactcgcaatctacagacggtgaacttcctatttatattactctcagtccaaaggaatactttgttctgacagcaaattataagggtggcagcatcacggtattctcacaggataagaaaggaaagttgcaacgtgatacaaaaataattcgttttgctggaaatgggccgaataaaaaaaggcaggaacaatcgcatctgcattgcgtgacctttacacctgatggcaaattccttcttgctaccgatttgggaacagattgtatctatctgtttccgataggcaaacgaccggaagcaggtaaggctcattctctgttggatgaatcaagagtagtccgcatacagatggattccggctcaggacctcgacatatatgttttcacccgaatggcagatttgcttatctcatcagtgaactctcgggtaaaataactgtattctcctataatgaaggcaagttggaacgtttacaaacaattgtctgcgaccctttcgttgcagagggaaatgcagatatccatgtttcatccgatggcaaattcctctatgcttccaagcacttgaaagaagatggcataattgtttattccattgattcccaaaaaggaacattggttcaaataggatttcagccaacaggtctttatccgcgaagttttgccatctctccggatggttgctatttggcagtggtttgcagggatgccaactgcatacagatattcgaaagaaaccgaaatacggggttactgaagaatacgggaaaaaatatccgactggaaagaccggcgtttgtcaagttcttataaattcatcactaaacagaaagcaatatgaacaagttaattacaaccatcgcctgcctgatatgctgtatcgtttatacgcaggcacaaaacaagaacaatatgttaagcaagaaagaacaaagtattgccgccatcagtatgtatgccgcacgtggcaatcaggacagcctcaaagtgatccttgccagaggacttgactgtgggctgaccgtgagcgaagaaaaagaagtacttacccagctctatgcctattgcggctttccacgcagcatgggtgcattggttacgctgatgaatctcaccaaagagcgtgcagcacaaggcataaaggatgaagccggacgggagccttctccggtaaagagttcggatatgtttgttgtcggtggacaaaaccagctgaaactgttcggtcgtccggcactaggagaagtgctgacatttgctccggcattggaccaatttctgaaagctcatctgttcggtgacatattcagccgtgacaatctcgactggcgtacccgtgaactgtctactgtggctgccttgtcggtgttggacggcgtgaagaatgagttgaatactcacattgcccatgccaagcacaacggcgtgacacaggctcagatagacgaagtacttatcatggcggcacgctgtcggaacggaatggtgctttctgaatccgatgaaccggcaaagacttttcaaacagatccgacaattactgtccgtaaggtcttttataaaaacaggtatgatatcatgctttgcgccgaaatgtacctcccgaaggatttcaatgaagcgcaacactatgcagccctcatcatcggacacccgttcggggctgtgaaagaacagtgtagcggactctatgcacaggaaatggcacggcgaggctacgtgactctggcttttgatgcttcctatcaaggcgaaagtggaggagaaccgcgtcacacggtatcgcccgacgcattggtggaagacttcagtgcttctgtagactggctcggactacaaccgtttattgaccgcaaccgtatcggtgtgattggcatctgcggaagcggcgggttctctgtctgtgcggcttctctcgacccccgcatcaaggcattggcaaccgtgagcatgtatgatatggggcgtgccacccgtaacggtttgggggattcgatgacggatgaacaaagacgcaaactgttggatgaagttgccgaacaacgttggaaggaagcagaaacgggagaagcacgtatccgctttggcacaccggagaaactgctgggaaatgccaatgccgtgcagaaggagtttttcgattactatcgcaaccccttgcgtggctatcatccgcgctatcaaggtatacgctttaccagtcaggcggcattgatgaacttctatccgtttgccatgattaaagagatttcaccacgccccgtgctattcattgcaggcgagcatgcacattcgcgctatttcagtgaggatgcctatcaagaagccagcgaaccgaaagaactgtatatcgttcccggagccaatcatgtagacttgtatgaccggatggataagataccgttcgaaaaaatttcggaattcttctggtatgctttgcggtaattcagatgaaaatggtaatgctatccgtgattatgatacagcaaagcgaatacgcaggagggtaactttgcaacagaaacaatttaaagattatagtatttgcaaccagttattactcaatattttgtgagttataagtcagaaatatgggcataacctttaggggtacattctaaaaggtgaagatttaacctttttattatttcttaacactcaaagagcggtggtagagggtattttccctcttttcggtactttattgatggttcgatgttcccatctttccacattgcttggctcgttcgcacaagccactacaaaggtactacaatttccaataaaggcaagaggacagcaattcaaatctattatttttgagggagtgaaatctgccgcttgccaaatttctctctgtcgaaaataatagtcctctgaaaagaatgaaaacagcattgataaaattgccttattaagggggggctatgctgttttatgctattatttcgtcagtcgtttatctccgttgccggatgcagttttcagccaagccgatgaataagaaaaggttttggagctgtttactctccaacggaggacgaaactgctccaaatggtttaccgcttgaacttttcgttttctaaaagaggtttggcaacctttgcatccgacaaaaggagataaatgaccagatatataacagtagtattacattaaggtaaagaacaaccatggtatagtattattgcaatttaactatttaaagtttgtttataatcaaatcatttaaagatttttgtccttctatgattttttgtatttgataaatgtcgtaattaaataaaaaatatcacgcataatgactttttcttttttctaaatttcttcaaatgacaaattattgttacatttgtaatgtaatgtagttaatggttgcgcttataaagtccttggaaaggatttatgtataaaagaggtagatgtttactctgttcttgtttggattatcagcatcactgatatgaaataacaaaaaaaaatatacaatggctaagcggacggacaggcagggaaatagtacagattcccaatccccctctttataatacattgcgtataagatttattaactgtctggtctggggaatctacagagatttaacgaatcaagatgggaagagtcagtctttgtcttgtcataatgttcttcatctgtagtgctcaaaaaattgatgcacaagtacagaatatcagagagaaacaagataccatttcggcgactaaatcattagagcatatcaggcccgagaatatcaagaagggaccattgaataatgctttggatgtattgagtggtcagtctgccggtgtgaacgtcaccactaatgggactgacaggctcgctatgctgaatagtatccgtgtgcgtggtaccacatccattatgggtggcaatgacccgttagtaattattgacggagtgacatctgacatcgctacgctatctaccatatatcccgcagacatcgagagtttcactattttgaagaatgctaccgaaacggcaatgtacggttcccgtggtgcttcaggtgtaattgagattaagaccaagaaaggaacggggcgaggtttcgaaatatcatatgatggcaactacggattcgagtcaatgtataaacatctgcaaatgctcaacggcccggagtatatagctacagcagaggcacttggattagattacaataatggtggctacaacaccaattttcacgatgtaattactcgtacgggcttgatacatcagcatcacttggcttttagcggtggttcggaaaactcaaactatcgagcatcgttcggttttatggatcataatacaattgtcaaagttaacgattaccgaaatttagtggtaaaacttgatgctacacaaaaggctttcgatggtcgcttagttggcgattttggtgtatatggctactcgtcaaagatacacgacattttcgatacacgaatactgttttactcggcagctgcacagaatcctacatatccagcaggaactgatgttaatggcaactgggtgaagaactcggctgcatcacacatcaaccaccccggagcactcctctatgagaaaaatgactccgaagaacggaatttcaatacacatttggggctgaaatttaatatccttgacaatttgatattgtcggctttcggctcttattcatattcatctacgggaaatgctcaattttgtcctacatgggtgtgggcgcaaggcaatgtttatcgtggagagttcaagggtgaagactactttacaaatgtgtccctctcatataacaatgcttggggagactcacaccttgatgctgttgttggcgcagaatatcttaaacaggtaaggactggtttatgggtgcaggcaaaaggaataacaacaaatgatttctcctataataacatcggagcaacatcatcgcgtcctttcggtggtacgagcagtagctatgaagacccgtcacttgcttcaataatgggtagtgtcacatatagttacaaggatagatattctattgcggcagcactccgtggagatggctcttcaatggtaagcgataacaatactttcggattcttcccatcagtatcactgggttgggatgtaaaaaaagaaggcttcctctctgatactgactttataacaatgttgaaactaagaaccggatatggtcggtcaggaaatcttggaggtataacatcctatacaacacttaataccgtaaaggagaatggtatcgtatccatcaacggtgcacctaccgtaacaatgggaagtatacgcaacacgaatccggaccttaagtgggagactcgttcaacatttaatatcggttttgacttaggtatatgggataatcggttgatgcttacctcggaattatattactcaaagacaacggatatgctctatgagtatgatgttcccgttccgacctttgcgttcgataaactgatggcaaatatcggctcgatgtctaaccagggtgtcgaactaggaatctcggtagttcccattcaacgaaaggatatggagatgaatatcaacttcaatatgtcctaccagaagaataagttactttcgcttagtggagagtataatggtatgcatatgacagcttcagatattactccgattggctcgctttatggtgcaggtcagaacggtggagacaataatgtagtatatcagattgtaggtcagccattgggggtattctatctacctcactgcaaagggcttaaagaaaatgaacttggtggctacagttacgatattgaagatttgaatgatgatggcgagattgattttagcgatggcggagacaggtatatagcaggtcaggcaacccccaaggtaactattggatcaaacatcagtttccgttacaagtcctttgatattgccatgcagataaatggtgctttcggtcataagatattcaatggcacgggcttggcttataccaatatgtctatattccctgactacaatgtattgaagggtgctcctgaaaaaaatattattgatcagaatgtttcagactattggttggaaaaaggtgactatgtaaatattgaacatattaccataggctacaatattccaatgaaatccaaggctgtgaagtcattgcgtctttcggcaggcattagcaaccttgcaacaatcacaggctatagcggtcttactccaatgataaacagttatgtagtaagcaacactttgggcattgacgacaaacgcacctatcctttatatcgtacctattcgttaggtcttagtattcaattctaaccgcttacagttatgaaaagatatataaacatattgatggttgctttggcaacgatgatgacctcttgtcttactgaagaccctagagatcaactttatgaagaagacatttacaacaatgccaacaacatatatattaatgcagtggctgtgctctacaattacattggtggcagtgcagacagtgagggtttacaggggacctgtcgtgggatttatgactataacacacttactacagacgaagccatgatacctattcgtggtggcgactggtacgatggaggtttgtggacgaatatgtatcagcataagtggagtcctaatgatttaccactctacaatacttggaaatacctctacaaggttgttgtgttatcgaacaaatctctgcatatcatcgataagtatagccataacctatctgaggagcagagagtggcctacgaagctgaggtgcgagctctgagagcacttttctactactacattatggatatgtatggcagagtgcccatcgtaacatcctatgaacaaccgcaggatgaagttgtgcagagcgagcgtagcgaggttttccgttttatcgtgaatgagttgcaggaggttgccgagttgttgccaaatgagcgtagtaataagatgggtaactactatggtcgtataacaacacctgtagctaatttccttttggctaagttggctcttaatgccgagatatattgtgatgataattggactgatggcgttccacggaacggtaaagagatatttttcaccgtcgatggtgagaaactcaacgcttggcagacctgtatcaaatattgcaataaacttgccgaggtaggttatcggttggaggacgattatagctataatttctctgtgcataacgagaactccaacgaaaacatattcaccattccgttggataagaacctctatgctgcgcagttctggtatctcttccgatcacgacactacaaccatggcggtgcgttgggtggctcatcggaaaatggtaccagtgccaatatctcaacagtcttagccaacggatacggcacagatgatgtagatgctcgctttgaaaagaacttctatgccggcatcgtagaggttgatggaaagcctgtaatgatggacaatggacagcagttggagtatttcccattggagctaaagttgaatcttacgggaagctcctatgtcaagacagctggtgctcgtatggcaaaatatgaggttgataggacctcacattccgacggtagacaaccggataacgacatcgtgctattccgctatgccgatgctctcctgatgaagtccgaggcaaaggtacgtaatggtgaggatggctcgttggagttgaacgaagtccgaggtcgtgttggtatgccatatcgagaagctacgcttgagaacatattgaaagagcgtttgttggagttagtatgggaaggctggcgacgacaagatatggtgcgttttggagtttatcacaaatcatacgatcagcgagtccaactggctgatgagaaaaatgggtataccacagtttttcctattccacaaaaaagtatagacttgaacccaaaattgaaacaaaatgttggatataaataactttagcctatgagtattcaatttgacattgcaaaacagattatagctgaaacatgccctaatcgcaaacttaagttggagaatattcgcctttttgcagatattattcagcctaagaaatatcaaaaaggtgatataattctaaatgaaggtgatatctgtaattgcctattttatatagaaaagggatttattagacagcactacctaaagcatgataaggatgtgatagaacatttagcatgtgaaaaagatgttgtctggtgtattgacagctattttaaccgagagccaacacatcttatgatggatgctgtagaaaacagtgttttatgggaaattccgcgtgatataatggaagaatatggaaaataagaaggaagagccaactttgaacaaggtaacgttcgtaaacggtgtgcagattaaaaacaaaagtggaaagcactgatgtgggataattttatctattatggtaagattaatcaaaacagagacagtcataagtgtactgatggggcattttataaagaaattattgtttatcttgctgtttgtcggggtactgattgctccggcaaacgcacaaaacgaaaagaatatgtattcgtacaagaaaattggcaacaagtatattgtcagcattaacaatcatactgaaattgtgaaagccctgaatgctttctgcaaggagaaaggaattctgtcgggttctatcaacgggattggtgctatcggagagctgaccctccgtttcttcaatcccaagacaaaagcatatgatgataagacattccgggagcaaatggaaatatccaaccttacagggaatatatcatctatgaatgagcaggtatatcttcatttgcatataaccgtcggcaggagcgactattccgctttagccggacatctactttccgcaatacagaatggtgcaggggagttcgtggtggaagattatagcgagcggataagtcgcacatataatccggatttaggactgaatatatacgattttgaaagatagttgcctataaatatcgcttggaatacaggataatacatcattcagcttagatgatatatatcaaaaaaagtttatcaattctgtcacgttaactttgcaacagaaataatttaaagactatcaaatatggataaagacaaggatatgagccgccggagattccttaaaatggcggcattgacaggagctgccatgtgtgtcgggcctaccttgaacaaggtaacggcagcagaacgggtatggatggggaaacaacaagttgcaaacaacatccctgcaggcatggcggcggtgcgcactcggcgaacattgggacacggaaatacggcattcactgtttctgcaatgggatatggctgtatgggcttgaaccataaccgcagccagtacccgagcagggaaaaagaaatcgccctggtgcatgaagctgttgaacgtggggtgacccttttcgatacagccgaaagctacggctaccacatcaatgaaaaattggtcggcgaagccttgaaaggatataccgaccgggtatttgtgtcatcgaagttcggacataagtttgtaaacggtgtgcagattaaaaccgaagaggacagcactccggccaacatccgccgggtttgtgaaaactcgttgcgcaatctcggagttgaaacattgggcatgttctaccagcaccgcatagacccgaacacaccgattgaagcggtggctgaaacatgcagcaaactcatcaaggaaggtaaaatcctgcattggggcatgtgtgaagtaaacgttgataccatccgccgtgcgcacaagatatgtccggttacggcaatccaaagcgaatatcacttgatgcaccgcatggtagagacgaacggagtgttggagctgtgcgaggatttgggcatcggtttcgttccatacagtccgctgaaccgtggttttttgggcggtatgatcaatgaatataccaagtttgatgttaccaacgacaaccggcagaccttgccacgcttccagcccgaagccatacgcgccaactatcgtattgtggaagttcttaacgctttcggccgtacaagaggcattaccccggcacagatagctttggcctggctgatgaacaagaagccttttatcgtgcctattccgggcaccaccaaactctctcatctggaagagaaccttcgtgcctgcgacatccgtttcacggcagaagagatagaagaactggaaacagccgtagctgccattcctgtggtgggtagccgctacgatgccttgcaggagtctaaaatcccaaaataatccgtgtatgaagaaacagatattttacatgacgttcatcgctttactgtcgggctgtaattgttacaaagggaatattctgcaaatagaggaacaaggcagttttgccgtaggtggcaccgtactgaccgattcattgggacacaaataccacggcgaccatgcttatgtattttatcagaaaccggttgatgcacggaaatatccgcttgtttttgcacatggtgtcggctagttttccaaaacatgggagaccactcctgacggacgcgaagggtttcagaatatatttcttcgcaaaggtttctccacctatcttgtcgaccagcctcgccggggaaatgccggacggagtacggaagctgtcacactggaaccggtattcgatgaagaagaatggttcaaccgtttccgtgtgggaatctatcctgattatttcgagggtgtacagttcagtcgcgaccgggaagccttaaaccagtacttccggcagatgacgccgaccatcggacctttggacttcgatgtctattccgatgcctatgctgctctttttgacaaaatcggtccggccatatttgtcactcattcacaaggcggtccggtgggttggtttactttgctcaaaacgaagaacatcaaagccattgtagcatacgaacccggtggaagtgtacccttcccaaccggtcaagttcccgaagaaggcaaagtcttgacacggtctaaaaaaacagaaggaatagaagtccctatggcagttttcaagagatacatggaaattcccatcatcatttactatggggataacctgcccgaaacagacgaacatccggaactttacgaatggacacgccgtctgcatctcatgcgcaagtgggccgaaatgctcaataagctgggcggtgacgtgacggtcattcatctgcccgatgtcggtctgcatgggaatacgcacttcccgatgtcggatttgaacaatgtggaagtagctgacctgctgtcgaagtggctgtatgagaaacagctggacagatagaaattaacagaggataaccccaaaacctaaataaaaatagttatgaaactgaagtgcttattggcaatgctgctcttaaccttcctttcgtgcagcaacactccggctgttgaagataagatagattcgttgcctcactcagagccggggaaaacattgatagtctatttctcatggagcggacatacgcaaactgtagccaacattatccatgaacttattggatgcgacatggtggagattgaaccggaagaaccctattctgatgaatataatgaagtggttgaccgtttcaaaaatgaaagagacaatcatattcttccagctctgcgtacaaaagtagagaatatggatgattatgatacattgattatcggtagtcctatttggggtggtcttctgtcttctcctgtaaaaagtttcctgtccggttatgatttgtccgggaaaaagatactcccattctgtacacatggaggaagcggaacagcacaaagtgtggataatatccgcaaactatgtccccatgctgaaatattgctgtttatggcagtcaaactgcaaactctcggaatgaagtgaaaaaatggctgtcagaagccggattttctgtcgaattaaattacgcccgtttaatagttttaatactgaaatgaaatatcctttgttatccgcactctttcatcccctttttcagagatttgcagatagaccagtagttgagattagggaatatgagattgtcttcctgacagggtcggtaacgctcgataatctgcaaaggagtatccaacagtttcacttggaacggcacttttgtcttgtaccgtttggacaatatccacttctcaccattcacttctacgatgttgctattggttagttccttgatgtccacgaaagagagggcagtgaagctggcgaaaacaaaaatgtcacgaatatagaacagttggacatccccaactcgtgcgtcatcaacgttttcagttcatcttccgtcaggaactcacgttccgtcacattagggctgatgtggaattgggcaaacgtttttttcggtattagtccgttaaagtgcacacacatgacaacgcctttcagccacatgcatttttcccatatcgtcccgttgtgaagtcccgctttcgttgataggtaggctgcaaaccccttgatgaagtcgggcttaatctccagcatgaacatatccgtccgtctgtaaaaagacttgatgaacgctgccacatggtttcttgccaccacccgtgaacggtggttgccattacccctgtcttttccgacacgcttcttgaatacttcgttctcacgtccggacgctttgagcagtgtctcatactcactgccgataccctgataagcattgctcaccatttcagccgtcacgaacgcttcacggtcgaatatacgcaggtagtgcttgatgatttgagccttgatgttgtcaagggcaaggttgatatcacgtacttccgcactcttgcctttcgccctgttccctttcacgtcccaaagcgttttcgggatactctacttatagctgaactgcgtcacaatcccgttaatcgttacccgtcctatgatgcggacaatatcgtttttctccttgttgccgttcacgtagaacagcactttgaatgtacttcttgccatactcgttttttaagtttaaaattaagtatcaatgagttatgccttgtaaaccaaccgaagccatacggagaaaaattcagcacggagtatcaaaaaccacctttcacggggtaatgatttagcaacctttctacttcataaatttacttttttttgcgttacctcgttttatgcctttgtcctcatttgtcctcacaaacgctttattcatagccgttttaaaaacatttccgcctttctattcctcttttccacagatttttagtaaatttatatccgtctaatttttaaggtcctatgttcagactcaatctaaccaaacattgcataaagtggtactgtttcatccaaatgcaactgatggacacgttcgtacattattttgtgcttgtatcgttatatctattgcagctattatctgtagttcatttgtatccatggcccattacagacaggcgttattcagtatgacttatttttcctccctggtgtttttttgtggagtatgcattgcgcatttgcggcaccggtcaaatatccggatagagacataaaccgtacacgatggaaatatattttttcattctatggtttgtggactccgtgaccattctcccttatatgttaacctatatgtattgggatacgaatattgtccatgtcattatcctcctttacatttttattattgtcaaatagataagatacttacggaagagtgggttatgacctatatacctgcggtatcatggtctgtttttctgctattctgctatactatatagagcttaatgtacagcttgaggatttcaaaacattcgtgacgggctttggtgggcagtaattctaagactttaaataaagaaaaattaagccaccccttaaaaaaaagagatatttcctttcaaagaattcatttcttttattacatttgtattagtcttttgaaaatagaagatttatagtaaagcgttaaggcattatccaagttcaggaaatccccaatttcgaaacaacaattggataatacattggacgctccacgttctatctatatggatttttgttatatataggcgtggggctttgtgtattatatgttgttgagtatggggatacttctgaacggtaataccaaagttcccacgcttaactttatataaacacaactccagggaacagggttggcttataataaacattatgaaagcaacttgttttaaaagcgagacaactgtctccaacgactttccccctttgtttgttactgtcttttgtggaatattctatcctttcatttccattcctgtctctttcggaacataccgttcattatcatacaaattacatgccaaagcacttttctgccttctcctgctatggtactagataatagtaactccccctatcacatagaggaagaactttggttacagatactttctctgtcaagagagttgcaggagtgtaaagctagtctgcaccataatactttggactgtatttccgataagattgaaggaatagaaagagaactggatgtcttattggatattctgcaagggaggcaagacaaaaagacatcatagtgctattttttatgacaatttgtctacgccgataagttatcctattatttaagcctcgtttaagaattccgttttatgggttacccacaatcgaatggaatttttatatactgagaataacacatgatattagtaatggattttcaatattcagagtgataatggataaacgaatagaaaacgccatgaatgagttgatcaatacagaaatatggtcaaccggtttatacctgtcattgcaggtttattttgaagatgaacggcttccaatacttagctcctggctgaactcccaagcacaggacaatatgaacaaggtttatcagatgatgaatcggatatgccatgatggaggatgtgttgtaatcaatgaaatgaaacgggatacacatgaatggacaacgccattgaatgccttgaatgaattgcttgaacatgagcagtacatatcacgtcaggtaaacacatttctcatattatgctggaatgtaagcatgtccttccattctttcatcagcgggctgtatgcagaccgtatatatgtaagtacggcatttatggaattgttacgtatcctcgccaaggaaaacgaacggaaactaccttatttttgacggtatggatttaagattgatgttatgcaaaatttaatattgcagaatgctatctggtatgttttttgcgatataataatcgataataaactatatgtcatcatggatatatttgtatatttaacattgtgtttcacttcgctattcaccttgatggaccctcttggagtgatgccggtattcctgcaaatgactgatggaatggatacgaaagaacgcagatatatcgccttgaaagcatgtaccattgcatttatcatattagtcctttttacattatcgggcaggtttctgtttcattttttcggcatctcaacaaacggattccggattgtgggaggtatcatcatctttaaaatcggatatgatatgttgcaggcacattttacccatgtgaaactgaatgaaactgaacgaaaagaatattccaaagatataaccatcacacctcttgccattccgatgttatgcggtccgggagcgatttccagtggaataacattgatggaagatgcttcggaatatactttcaaaatagtattgcttggcgtaatcgctttggtctgcattctttccttctttattctgtgcgcgtccacccagcttttaaaaatcttgggagagacgggaaacaatgtgatgatgagactgatgggacttattctaatggtgatcgccgtggaatgttttatcagcgggatacgtccggtattaattgaaatcttgaaacaagcccatgcttgttcttaaagaagagagataatacccgttggcggaattaacttagtgcgtatttaattctgccaataggcttgttatgtttgatttttcaaacgaaagatttcagctggcttgtattgcttgttgtgtacggagtggatagtgtgttgacgatcgtacaccggttgttgctacatgaaaatattggtttgcctcaccggaaacatttgtatcagattatggccaatgaattgaagatttctcatgtaactgtatcattgacttatatgttcgtgcaagccatggttgtggtaggatatctggtattacgagagcatggatattattatttattagggattatcttactgttgggtatgttatatcttctatttatgaagagatttttctatttacataaatctaattaatcagttatgaaaaatataacagaaaatgatttttaatatgcagtagattggttggaattggagaggctatcagtggtgttttgttaattgagattctgttttggggaactattcttttctatctttgtttttaaagaaacgtatagaacacaatttcctcaatatctatgttgacatttaccgataactttgagaatgataaagagttgatactccgtgatcatttggcacttgaaagaacaaagttggccaatgaaagaactttgtttgcatatatccgcatgacactttatctcctgactgtaggaatagggatctttcaagttgaaagtatctcacgtctgcatgggctggcgtgggtgtgtattatggccgggatcattttattctttttaggctttgtccgcttcgggcagatgagaaagcatctgaaacagtatacgaaaacatgtcgtgaggctgagagtaagtcattgcaggagaagtaatccctgttctcaatcatccaatccgattggtttgttttcgtgtatttctatggttttggtggctaccgcatattcatcggggaaaatcttaccacccatttcgtttgcccatgctttggtgaactctgcgcctgtatatatgatgatggaagaataataaatccacgtaacgaaaacgaccatgaatgctgctgctccgtaaacggttcctacgtttgcaatccctatataaaatgagattccccattgacctaccagtagcagtaatgtggtcacaatcgctccaataaaaacatctctgctttttattttggcatcgggcaatattttgaaaatcaatgtgaaaatgatggccgttacacctatatttataatgattcctactacctgaaccaatgacccggctatttcgggataattaaccataaactttttactcaattctccgatgatgctggtgatggtaaatgtaatcagaaggatgaaagcaaatacaagtattatggaaaaagagagtattctgtttttgataaatttgagccagctttttttaggaacagcttttattccccaaattgtgttcaatgaactttgtatctctgcaaagatggtggtagcaccgaaaatagaaatgcctaagctgacaatggcagcagatctggaagaatctgtatgttctgcattttctataatggagcgaagtgcttcggtgatttccggtcctacaatgggttgcaactgtacataaagctggttggccaaatccatatggaaaaagactccgacagtgaccaggagagaaagaaaagggataattgaaaacaatgtcgcataagccaatgaagcgctcagcctcataacgctgtcgtctataaatccccaaactgtatcttttattattttgaacagtaggggtaaactaagctttttctttttctccgaatgaatttccattttaacttttctttatccaaacggcaatattacgggcattaacagagaattttccgtttcctttctcatctaaagtgacctcttcgggaatgcttccggtgatttcatgccatacttcacctttatgttcttcacccggattcatcattttgctaccggcttcatcatttgacattaagaagaccagaccggagccggtgtgttctttatctcccgtacggatgaaaccaatggtagaaggatgatcgaaatattcgatctgatcaccgtaggcatattttcgccttgcattcagtaaagtatcaatgatcggggcatggggagacttttcgccttttacaccataatagtctccatagaacaggcagggataaccgtttttcatcaataatatcaaaccataggccagtggcttgaaccagtcctctatttgtgattctaacgaactgcccaattgtgagtcgtgattatcgacaaaggtgactgctaaatcgcaatgatgttcgactaatgtgcccttcaagatattctgcaaatcataatttttgccttcttgtgaagcctgaaacatattgtaatgtaacggaacatcaaataagttgactttatggcccacagattctatgtatgcatcgagtgttttcagatctccgttccagtattcacctacagcgtaaaagttgtttcctctttcactccttaccgcatccagaaattgtgcgatgaacttatccttcatgtgcttgatggcatccaaacgcattccgtcaaggttcagttctttggaaacccattttccccagcgattcagttcggcaattacttccggatgatccaggtcgatgtcgttacataacaggaaatcatagtttccattttcgctatctacaccctcgctccatgctttgccttctccttgtatctggaagatgccgctccgctttttggcatcgtcaaagccggttccggagaagtgataccaatgccaattgaaatcagaatatttatccttgcgtccatggaaactatatccggtccagctttgtatctcgaacggctttcccaatccttgggttctgtcatggggatcaacttccacaaccataaatttttcagtgaaatcacctccggctttatggttgagtactacatccagatatactgaaatgtggtttttatgtaactcgtcgatcgcttctttcaattcatcttttgtgccatacttcgttcttacggttcctttttgttcgaactcgccaagatcatacaagtcataggttgcataaccttcatcttgctgctcgtcggctttataagcaggcggaatccaaactgctgtcacaccgattttatgtagatgtgatgcgtcttcttttaattgtttccacaactttccatcgtttggcagattccattcaaaatactgcatcattacgccattttccatcatcttaatgcatttaattatcagcaaataacaaaaaaaacggcataaggttcctttgtatttgcaaaaaagtactttgggctattttgctttaaaaagctatctgatgttgacggtggcgtgattatgactttctgtggctaagtttgtgtgctggtggcgttatttatctttccgtcatatccccatttcacgtagacggctccccaggcaaatccggctccgaaagcggtaaagatcaaattatcaccttttttgagcttatcttcgaaatcccatatacataatggaagtgtgccggcactggtgttgccatagcgttcgatattgatcatgactttttctaatggcatatccaggcgctgggcgacagcattgataatgcgttgattggcctggtggggaataacccagtcgatttggtctttcgttagctgatttctttcgataatcgattcacaagcatctgacatattggctacagcatatttgaatactgtacggccttcctgataaagatagtgcatgtgattgtctatcgtaaaataagaaggagaacatacggagccgccggctttcatatgtaaaaaagggagtcctttgccgtctgttcttaaaacagaatctataatgcctaaatgatccgtagtaggttccagtaagaaagctgctgcaccatcaccaaaaataggacaagtggcgcgatcggtgtaatctatcaccgatgacatcttatcggcaccaactatgatgacctttttgtatcttcccgaacggataaagttggctccggtctccagagcatataagaaaccactgcatactgcctgcatatcaaaggcgaatgcattttttaatcccactctttcacacagaatggaagctgttgaaggaagccgataatcgggagtggttgtagcgacaattaccagatcgatgtcatccggatggctttttgtacgttgcatcaattgtttcacagccttacgtgccatgtatgaagtgccaagaccttcttcattcagaatacgtctttccttgatgccgatacgccccatgatccattcatcggtggtatctacaattctggatatctcatcattagtcaggatgtaatcgggtacatatcctccaactcctgtaattactgcattgatttgtttcattaactttgtctaaataagtaagttcttaagtgggggaagtataaaatgactccgaaaacttacgacttttcggaattgcatctaaaataccgggcgcaaatatacagaaaagaaagacttattctatattttgtaatctaaatgcattgattttcgtagtgagattaggataagttataatactgaaaatagaattagggaaatgatagagaaaaggagaggtgttttttgtttaaaaaaggaagaaataatctattctgatttatacaataaaaaactcctgcaatcatatgactgcaggagtttgtcaatatagaatggcttaaattactttgccagagcctgagctacgtcaactgcacaagctactgtacaacctaccatcgggttgttaccaattcccaggaatcccatcatttctacgtgagcaggaactgaggaggaaccggcgaactgagcgtctgagtgcatacgacccatagtatctgtcataccataagaagcaggaccagcagccatgttgtccggatgaagagtacgacctgtaccaccacctgaagctactgagaagtatggcttaccggccaatacacgttctttcttgtaagtacctgcaaccgggtgctggaaacgagtcgggttagtagagttacctgtgatagatacgtccacgccttctttccacatgatggctacaccttcacgtacatcatctgcaccatagcattttacttttgcacgaggaccgtcagagtaagcaatttcacgtactactttcagttcgcctgtgaaatagtcaaactgtgtctgaacataagtaaagccgttgatacgagagatgatctgagcagcgtcttttccaagaccgttcaagatacaacgcagaggttctttacgtactttgtctgcttttgcagcgattttgatagcaccttcggcagcagcgaaagattcgtgacctgccaggaaagcgaaacatttagtttcttcacgcaacaacatagcagccaggttaccatgaccgataccaactttacggtcgtcggctacagaacccgggatacagaatgcctgcagaccgatgccgatagcttcggcagcgtcagctgcatttttgcaacctttcttgatagcgatagcagcacctactacgtaagcccacttagcattttcaaaacagatcggttgagtttcttcacacgttttataaggatcaactccagcagcttcgcagatagcgttagcttcttcgatgtctttgataccgttagcgttcaaggcttcgatgatgcctttgatacggcggtcctgactttcaaattttacttctctaatcataatttcttttcctccttatattattcgtgacgtggatcaatgtgtttaacagctccctgttctgcagtgaagcgtccgtaagtaccggtaactttcttcaatgcttcattcgcatcagtacccttcttgatttcgtccatgaatttacccatgtggacgaattcgtatccgcagatttcatcgtttttgtcaagagcaattgtcttgatgtaaccttctgccatttcaaggtaacgaggacctttagccaaagtaccgtacaatgtacctacctggctacgcagacctttacccaagtcttccagacctgcaccgatgatcagaccaccttctgagaaagctgactgagtacgtccgtaaacgatctgcaggaagagttcgcgcatagcagtgttgatggcatcacaaactaagtctgtgttcaatgcttcgaggatagtttttcccgggaggatttcagcagccatagcagctgagtgagtcatacctgaacagccgatagtttcaaccagagcttcctggatgataccttcttttacgttcagagtcagcttacatgcaccctgctgaggagcacaccaacccacaccgtgtgtcagacctgaaatatcaacaatttcttttgattttacccattttccttcttcgggtatgggagccggtccatggttaggacccttctttacaacacacatgtgttccacttcgtgtgaataagtcataattagctctttttttaagtgatataattaaaaatacgtagtcacgattctcaaatcgctcacaaaggtagtcgttttatttgtttttgcaaatcgggttttattacttttttatgaaaagggaaaaatagaaatttcagtttcgttagattgtaatgtggagatgacattttagataatctttattttgttgaactattactctgattctttgtttcttttgagaaaaattgatcggttatgaatttgaatgaagtagatatacattatttaatagcagccatttgtgtgataacttctgcattggtgttttacacaataggagtgtggggagagcggttgcagaagaaactgaaattttggcatctggtctttttcttattggggctattggccgattctgtgggaacagctttaatggagaatattgcgcgactcacacacctgcatgatgaaatacatactgtgaccggcattatcgctatcttgttgatgtttgttcacgctatgtgggctatctggacgtatgtgaaggggagtgaaaaggctaaagaacatttcaatcgtttcagtattgttgtgtggtgcatttggttgataccctactgtataggcgtatatcttggtatgtcgttgcatcattgaaaataaccttatttgagaaagtaataaagcttcatctcagccgctaagatgaagaattatcccgtaagagaaccattgaagaactcaggggatatattccaaagcgattggggaatttttaattatgggctttaaaaataggacagtttctaaaaaactcttcaaaaagcctttctgaaccatatatttccgtatttttgtttcctgatatttataaatgtagaatttaccttattatatatagtggaaatgatagaagttacggatgcctccttgcaaaaagctgcgggcgagggaatggatgaatttatccaggtgtttacagataagtataaagaagtgattggcggggagcttactgccgaaacaatgccactattgacaggagagcagcactctttgttggcctatcagatttttcgggatgaagtcatgtttggtggtttttgtcaattgattcagaatgggtatggaggttatatctttgataatccttttgcaaaagtgatgcgtttgtggggagccgaggatttctcgaagttggtttataaagctaagaaaatatacgatgctcatcgccaggatctggagaaagagcgtacggaggatgaatttatggcgatgtacgagcaatacgaggcctttgatgatcttgaagaagaatatctggatattgaggaggaggttacagcactggtagcaagctatgtagacgatcatttggagttgtttgcaaaaatagttaagtgatggatgcagtattttttaagtctctgcatttacttattgtgaattagaatttatatctttgcaaactctaaaaaatagatttatgaaacaattgaaattaatggtgttggccttaaccctgttgatgggtactatgtttacttcatgtatggattccggagaaaacggtcctcagcagtgggctggtgtggtgaaagtgaatgatagaatgggttatgttacgtttacagatgccgccggtacggaacttatccccactaacacagttcctgttactttgagtgcaagaatggcctatatttattgtcaggttgatgaaggtcaggacctctcgacaaatcctaaacagattaaggttacgcttttagcagatgcgactggaatcgatgctcctgcagttactactacggctgtcggtggttcgggagatgtgactactaatgcaccaattggttcattgagttttgcatcaggatattcaacggtagccccattccagtttagtgaaaatacaattgtattgccggtactttaccgtgtgaaaaatgtaactactccggaagatgttaagaatgaactcgctaaacattcttttactctggtttgctatacagatgatattacttcaggtgctacagaactgaaactccatttgcgttatgctgttaatgatgaaactactgctatagtagaacgtgcgacacgtacttccagctttaaagcttatgatatcactgaatttttgagagaatataagcagaagagtggacaagataaaccagccaaaattattgtggtggcgcagcagaatgaatacaataataaaatagaagattcttctactacagagaaggcgtatgaaatagaatataaaaccgctaaataatttgaattacaaagcattatttcaaatagcaatgtcattgatttcctctccggccaaggcctgggaggaaattcgtttagaggatagacgggcagttcttactgtttttgtctatcctatgattggtttatgcggtttatccgtattcattggtgctttgtggaccaatggatggggaggaccgcaaagttttcaattggccatgacgcagtgttgtgcagtggcggtagctttgttcggaggctatttcctggcagcttatgccatcaatcagatggggataaaaatgtttggcatgtccaatgatatccctttggcacagcagtttgcaggctatgcattagttgtcacctttttgttgcatatagtgaccggattgcttccggatttcagtattatcggttggttgctccagttttatatcgtttatgtggtatgggaaggagcaagagtcgtgatgctggtggaagaaaagaatcggttgcgttacaccattttctcgtcgattttgttaatactatgtccggcggtaatacaagttgtgttcaacaagctaacagctatattaaattaagaaaataaaatgaaactggctcctataaatataaagaataaacgtgctactttcgactatgagttgatcgatacttatacagcaggtattgtgctgacaggaacggagattaagtccatccgtttgggaaaagcaagtcttgtagatacgttttgttattttgcgaaaggtgaattgtgggtgaagaacatgcacattgccgaatatttttatggttcgtataataaccatgcggcccggcgtgaccgtaaattgttactgagcaaaaaggagctgaataagttggaacgagggacgaaagacgccggatttaccattgtcccggttcgtttgtttattaatgaaagaggtctggccaaagtagttgtggctttggcaaaaggtaaaaagcaatatgacaagcgggaggctttgaaagaaaaagacgaccgccgcgatatggacagaatgtttaaacgatgataggtttgtacctttagcaatgaaaagaactattcaacagctggtacccgaacgtatccttatattggatggcgctatgggtactatgattcagcaatataatcttagagaagaggatttccgcagtgagcgctttgcgcatattcccggtcaactgaaagggaataatgatttactttgtctcacgcgccctgacgtggttcaggatatacaccgtaaatatctggaagccggtgccgatatcattgagacgaatacatttagttccaccacaatttctatggccgattatcatgtacaggagtatgtgcgtgaaatcaatcagacggccgtgaagctggcacgagaagtagccgatgaatatacggcactcaatcccgataaacctcgttttgtggccggttcggttggtcctaccaataaaacatgttccatgtctccggatgtgaataatccggcctatcgtgctgtgacttatgatgaaatggccgatgcttatcaacagcaaatggaagcgatgcttgaaagtggggtagatgctttgttgatagaaactatttttgatacgctgaatgcaaaagctgctattctggcagcggagcgtgctatgcaggcaaccgggcttaaagtaccggttatgttgtcggtgacggtttctgatacaggggggcgtactctttccggccagacactggaagcttttctggcttcggtacaacatgccgatattttttctgtcggtctgaactgttcatttggtgcaaagcaattgaagccgtttttggagcaactggccgcacgtgctccttactatatcagtgcatatccgaatgcaggtttgcctaacagtctgggaaaatatgaccagaccccggcggatatggcacatgaagtaaaagaatatatccatgaaggtttgattaatatcattggcggatgctgtggtactaccgatgcttatattgccgaatatcccgcgttgattgccggtgccaaaccgcatgttccggctcgtaggccggattgtatgtggctttcgggattggaactgctggaagtaaagcctgaaattaactttgtcaacgttggtgaacgttgcaatgtagcgggttcccgtaagttcctccgtcttataaatgaaaagaaatacgatgaagcattgtctatagcccggcagcaggtggaagacggggcgctgattatcgatgtcaatatggatgacggactgttggatgcgaaagaagagatgacaactttcctgaatctggtggcttcggaacctgaaatagctcgtgtccctgtgatgatcgattcttcaaaatgggaggttatcgaggccggcttgaagtgtctccagggaaaatcaattgtgaattccatttcgttgaaagaaggagaggaaaaattccttgaacatgctcaaatagttcgtcagtatggcgcggctgtagtagtgatggcctttgacgaaaaaggacaggctgatacggctgcccgtaaaatagaagtttgtgaacgtgcttatcgtttacttgtagataagattgggtttaacccgcacgatatcattttcgatccgaacgtgctggctgtagcaacaggtattgaggaacataataattatgcggtagactttatagaagcaactgcctggattaaaaagaatcttcccggagcacatatcagcggaggagtaagtaacttatcgttctcattccgtggaaataattatattcgtgaagctatgcatgccgtattcctttaccatgccattcagaaaggtatggatatggggattgtaaaccctggtacttctgtgctgtatacggatattccggcggatgtgcttgagagaatagaggatgtggtattgaaccggcgtcctgatgctgccgaacgattgattgaactggctgataaattgaaggaggcttcggcaggtaatgctgcggcaggacaaccggtgaagcatgatgcctggcgggacgggacggtagaagaacggttgcaatatgctttggtaaaggggatcggagattttctggaagaagatcttgcagaagccttgccacaatacgataaggcggtagatgtgattgagggaccgttgatggatggaatgaatcatgtaggcgagttgttcggtgaaggtaaaatgttccttccgcaagtggtaaaaacagcccgtacgatgaagaaagccgttgcaatcttacaaccggtcatagagtcggaaaaggtggaaggaacctcttctgccggaaaggttctgttggctacagtgaagggagatgtgcatgatatcggtaaaaatattgtttcggttgtgatggcttgtaacggctatgatatcattgacctgggagtgatggtgccggctgaatcgattgttcaaaaagccatagaggaaaaggtagatatgataggccttagtggattgattactccttcgttggaggagatggtgcatgtggctatggagttggagaaagccggactggatattccattattaataggtggagcaaccacatccaaactacatactgcactgaaaattgctccggtatatcatgcaccggtggttcatctgaaagatgcttcacagaatgccggtgtcgctgcccggttgatgagtccgaaattgaaagaagaactggcgcaggagctgtctggtgaatatcaggtactccgtgataagagtggtctgatgaagcgggaaactgtttcattgaaagaagctcaagaaaaaaggttgaaactattttgataaaaaagaatctatgggaacaaagaaagtgatttatgcatgggcgattggattgctttggatgatttcattcactgcttgttcatcttcttccccaaaagaagtcccgtcagcatccaatgctgccttggataatatttttgcgcgtaagagtgtacgtgcttatctggataaggaagtagagaaagagaaaatagacttgatgttacgtgccggtatggctgctccgtcaggaaaagaccttcgtccctgggagtttgtgctggtcactgatcgggttgctctcgattctatggcttctgcattgccttatgcaaagatgttgactcaggctcgttatgccattgttgtatgtggtgatgtggcccgttcttcttattggtatctggattgttcggctgctgcgcagaatattctgttagctgctgaggctcagggattgggtgcagtatggacagctgcttatccttatgaagaccgcatccgggttgtccgcaagtatacggagcttccgggaaacatagtgcccttatgtgtgattcctttcgggtatccggctgctctgcaggaacctaagcagaaatacgatgagaagaaggttcattacgagaaatattaaaccgtaaattgatttttctgaaagctgccctgataaaaagaggcggctttttttatttttgttccttttcttttttataaattctgcattttgtttttccatttcaataaattccttacatttgcaccaatattaatcgaaatctaatacaagaatgtttggaataagcgactctcttatcattttgccatatctgctttcggtagtatgtgtgctttttgctgcctggtttggtcttaaatattggaataaagacgatgaaaaagataaaacacgatgaatacatttacacttggactgattgtgatagcttatctgctatcattggcttatcttggttttttaggttataaaaagacaacttccgccagtgattatctggtagggggacgacagatgaatccatttgtcatggcactttcttatggtgctactttcatatctgcttctgccattgtcggttttggtggggtggctgctgccttcggtatgggtattcagtggctttgttttctgaatatgtttatcggggtggtgattgcgtttatctttttcggcctccggacacgcaggatgggagccagactgaatgtcagtacatttccacaattgttgggcgggcattatcgttcacgggggatacaggtgtttgtggccgcagttatttttcttggaatgcctttgtatgcggcagtggtaatgaagggaggagcagtttttatcgaacagatttttcagattgattttaatgtctcgcttttgatattcaccctggtaatagcggcctatgtgatagctggaggtatgaagggggtgatgtatacggatgctttgcaggcggttattatgtttggctgtatgctgttcttgcttttttcattgtatcgggtactggatatgggctttacggaagctaatcaggcgctgacagatattgctcctttggttccggagaaattcaaggcgttaggacatcagggatggactgccatgcctgttaccggttcacctcaatggtatacattggtcacttctttgattctgggagttgggatcggttgtcttgctcaacctcaactggtggttcgttttatgactgtagagagtagtaaacaactgaaccggggagtccttatcggatgttttttcctgattatcaccgtaggtgctatttatcatgcaggggcactaagtaatcttttctttcttaaaaccgaaggtgtagtggctacagaagcagtcaaagatatggataaaattattccatactttataaataaagcaatgccggactggtttgccgcacttttcatgctttgcattctttctgccagtatgtctacactgagttcacagttccatacgatgggtgcctcggtcggttctgatatttatggtacttacaagcctcgttcacgtggcaaactgactaatgtaattcgtctgggagtgctgttctcaatattagtgagttatatcatttgttatatgttgcccaatgatattattgcccgtggaacttctatttttatgggtatctgtgcagcagctttccttcccgcatatttttgtgccttatattggaaacgcgctacccggcagggagtgatggcaagcctttggataggaactataggaagcttatttgctttagcctttcttcatcagaaagaagcggcagctatgggggtatgcagatggcttttcggtaaggatgtgttgattgaaacctatccttttccgatgatagatcctatattgtttgcattaccattgtcagtggtagctgttatcattataagtttgctgacaggaaaaggaaaaaaataaaaatgcgttgtcaagagtctgcaatttttttgattgcagactttagaagcatttcagctttttatttttttcttgtacgattcgtacctcgaattgatatctctcacaaaattatatgtttctattccacgaaaatatccgtttttacacaccggatcggtgaagtactcttcattgcttttcagtaggatgtaattttctacattatcggtccataccgttttatttttgccatatttatctgccagtgcaatagcgtcaaaaatatgtcccaatccggcattatatgaagcgaggataaatttaatccgctcctgtttatccggaactatactcagactacggtctgtggctgcaatatattttacggcagctttgatactttcttccggattttgttcttttcccggtgggactcccattgcacgtgcagtagcaggcattaattgcatcaatccctttgctcccgcccatgatacggcagtagtatcgaaattggattctgtataagctaaagatgccagcaggcgccagtcccagccaatctctttggcgtattttttgaataagttatcgtagtgagagattttgccttcttttaaggacaagatgggagagtggggcactgctttgctgatttcgaaatatcttttcatactggctgtatacgcaggtgaggtcatattttctttatgccatttgtttgctgcttctgccagttgcgggcaatctttacgcactgcccatgcagcccgttggtcaaaactgatagaaaggccggtattcagattgggataataagtagcattcagtttggctacatcattatccgcaactgtataggggattttaccttgtgcaatctgagttatcagatcttcagcggtaatgctgtcattggttactttatgaatatgaatacctccgccaagctctttatccagattgaccaaccgctcgtaatatttgccaggtttcacgtatatatctttgccgatcaattcggttacatccttcagtggttttgtttttccggtgtttcgctgaacaatcacctggtgggtgatcacttcttcaccgcaataaatcagactgtcttttaattctttggtaattggaatattatatgcaataagatctccttcaccattcagcaatttccggattaattctggtacatccttggcaacctctatgcgtaattttacgcctaaatttttagcgaattgttcactgagctcatactggaaacccatgtcttgcccacggtaaatgaaataagatgttgaactgtaaagagtgagaacgacgagttcgccactatctttgatttgctccagatcgtgtgcagaagtatcttctgtaatgattacctgcttattacggcaggacagtatacagaagagcaggaaaaagagagagtaaactacgaggtgccgtttcatgactaaccgatgtgttttttgatgtacatggtcaatatatcgatagctacttgattgcttcccccttcagggacaatcaggtcggcataacgcttacaaggttcgatgaactgcaaatgcatgggtttcaggacgcgtgtgtatcgctccattacagcttctgccgtacggccccgttccactacatcacgttggatgacgcgtatcagccgttcatccggatcggcatcgacgaatattttcaggtccatcatattacgcagttttttgtcgcatagggccaggataccttcgataatgacaacttcacgtggcttaatatgtattgtttcgggctgacgggtacaggtcagataggaataggtgggctgctcaatgcacttgccttctttcagcatggaaacatgtttagacaaaaggctccactcaaaagcgtccggatgatcaaaattgatgttctgccgttcctccaccggcacatgactgctgtctttatagtatgaatcctgtggcagtaatactacttcgccagccggcagactctcaatgattttccgtacgacggtggtctttcctgagcctgttccgcctgctattcctattattaacatccttttatagtgtatatttgaaacaaatagagtaattttgcaactgtaaaaaacaactttggctgacaaatataaaaacaaataattaaaataacaacgtaatggtaaaacacattgtattatttaagttaagagacgatgtttctgtagaaaagaaactcgttgtgatgaatagttttaaagaggctatcgaagcattgcctgctaaaatctctgtgatccgtaagattgaggtcgggctgaatatgaacccgggggaaacctggaatattgcgttgtatagtgaatttgataatctggatgatgtaaagttctacgctacccatcccgaacatgtggctgccggtaaaattctggcggaaacgaaagagagccgggcgtgtgtagattatgaattttagttataaaaaatgatagctatttaagatttgccgaaaactcaaacccggaaatttggatagctgttatatttttagaaacatcataaacaatttaaagaatgaagaaattatcctcttttctgcttttactgctggttgtgtttacggcacaggcgcagatacaagagcctgtaaagtttaaaacagagctgaaaaccctgtcgggagctgaagcggaaatcgtttttactggtacgattgatgccggttggcacgtatattctaccgatctgggtgatggcggccctatctctgcaacttttaatgtagagaagatatcaggtgccgaagtggttggtaaattggccccgaggggaaaagaagtttcgagctttgacaaactgttcgaaatgaaagtgcgttattttgaaaagacggcccagttcgtacaaaagataaagtttaccggcagtgattattcgattgaaggttatctggagtacggagcttgtaacgatgagaattgcctgcctcctacacaagtccctttcaaactttcgggtaaggcggttgcgacttctgcagcttcggtaaaagagactcctgcagcaccggttgaagagcctgtcgcatcagtttctgatagtattatagaaccggtagctactgctgtaacttctgctgtaggcagcattgatttatggaagccggttattaatgatttgaagaagttcggagaagcaaattctcaggaagatatgtcctggatctatatctttattacaggattcctgggaggtttgctggccttgtttactccttgtgtatggcctattataccgatgacggtaagcttctttttaaaaaggagcaaagataaaaagaaaggtatccgtgatgcatggacttatggggcatctatcgttgtgatctatgtggcattgggacttgccattactttgatattcggtgccagtgcgttgaatgctctttctaccaatgcggtcttcaatattctgttctgtctgatgttgatcgtatttgccgcctctttctttggagctttcgaactgacacttcctgcaaaatggagtacggctgtagatagtaaagcagaagctaccagcggattactgagtattttcttgatggcatttacattatcgcttgtatctttctcttgtacaggccctattatcggattcctgttagtacaggtttctactaccggcagcgtaattgctcctgcgattggtatgctcggttttgccattgcgctggctctgccgttcactttattcgccttattcccgtcttggctgaaatcaatgcctaagtcaggaggctggatgaatgtgattaaagtaacattgggctttttggaattggcttttgctctaaaattcctgtctgttgccgatttggcatatggatggagaattctggatcgtgaaactttccttgctttgtggattgtgatttttgctttgcttggtttttatctgttaggcaagatcaagtttccacacgatgacgatgatacgaaagtgagcgttcctcgttttttcatggcactgatctctttggcttttgccatttatatgattccgggcctgtggggagcacctttgaaggctgtcagtgcgtttgcaccacctatgaagactcaggactttaatctttataccaatgaggtacatgctaagttcgacgattatgacttgggtatggaatatgcccgccagcataacaaaccggtgatgctcgattttacaggatatggttgtgtgaactgtcgtaagatggagcttgccgtatggactgatccgaaggtaagtagcattatcaataatgattatgtattgattaccctttatgttgataacaagactccacttaccgaaccggtgaagattacagagaatggaacagaacgtactctgcgtacggtaggtgataaatggagttatctgcagcgtgtgaaatttggtgccaatgcccagcctttttatgttctgattgataatgaaggtaagccgctgaacaagtcatatgcttatgatgaagatatatccaagtatatagacttcttgcagaccggacttgagaactaccggaaagaaaaataaatagtgtgttcaatgaatgaaaagaaaggctgccttcgcataaagcggggcagcctttcttatgttttattattgctttatcgcattggtacttccattaacaataaagttgcttcctggattacctccactttaaagttcttcgtatcccagagtccgataccgtcacgctttgataacagattatctgcaaccttcacatccccttcgatgatgaagatataaactccgttaccttcttggtgcaatttgtattcaaagctttttccggcatcaaatgttcccatggaaaaccaggcatcttgtttgatggaagcaggtaccttaccgtcaggcgagataatcaagaccggttcgtttcttttcagtaaggggcggatatcgtagttgttatattccggttctgtattctcgattctcggaaatatccatatttgtaggaattctaactgttctttatcgctgccattatattcgctgtgaaagatacctttacccgtactcattacttggatatcgccgggagtgatggtttgggtgttttttacactgtcaccatgtctcagataacctttcaagggaatagaaatcacttccatattctggtgaggatgtgtatcaaatcccattgatggagctacactgtcatcattcagcaccctcaatgcgccaaaatgcattctcgatgggttgtaatagtttgcaaagctaaatgtatggtaggttttaagccagccatgattgaaataacctctggaggaggctttgtctactactgttttcatatttttcctttcttcaatagaatattcgtataacaaatgaatgatagataaagttctggtagcgagaattgtgcattttacaaaaagatttatatctttgagcaatttaaaataggaaagtatgaaaaagattattaatccttggaagggaatggaaggatataattgctttggttgtgctcccaacaatgaagccggtgtgaaaatggaattttatgaagaggatgatgaagtgataagtatctggcgtccgcgtcccgaataccaaggatggattgatacgttgcatggaggcattcaggcggtacttctcgatgaaatctgtgcctgggtggttctccggaagttacagacgacaggagtgacatcgaaaatggaaactcgctatcgtaagtcgatcaatactaatgattcgcatgtagtactcaaggcacatattaaagaggtgaaacgcaatattgtactgatagaggcacgtctttataacaaaaatggagaattgtgtacggaagcgatctgcacttatttcacttttccgaaggaaaaagctaaagaagagatgcactttttatcatgtggagtagaagatgaagagatactccctttgatttgaaagaaaaacggaagtttttctgataattgtttggtgattcggaactaatagtttatttttgtcgcataaagaatgaagatatgaacattactattacacatcgccatcatcattactcgatcgaataactcggtgggcaggatgatattgtgtatatatatgatagaatacgaggcttaccgataaggtgggccttttttattttccggatattgaatttaaattgtaaattaagatattgtaattatgttaagaatcgcagtacaagccaaggggcgcctttttgaagaaacgatggcccttcttgaagaatcagacatcaaactgagcacaactaaacgtactttactcgtacagtcgtctaattttccaattgaggtgcttttcctccgtgatgacgatattccacaatctgtggctacgggagttgctgatcttggtatagtgggagaaaatgaattcgtagaaaaacaagaagacgcagaaattattaagcgtcttggattcagcaaatgtcgtttatctctggctatgcccaaagatattgaatatcccggtctaagttggtttaatggaaagaaaattgctacttcatatccgggaattctggataatttcatgaaaagtaatggagttaaagccgaggttcatgtcattaccggatctgtagaggttgctccaggcatcggactggcggatgccatttttgatattgtcagttccggttctacgttggtcagcaatcgtctgaaagaagtggaggtcgtgatgaagtcggaagctctgctgataggcaataagaatatgagtaaagagaagaaagaggtattggacgaattgcttttccgtatggatgccgtgaaaacagccgaagataaaaaatatgtattgatgaatgcacctaaagataagttggatgatattattgccgtattgccggggatgaagagtcctaccgtaatgccattggcacaggaaggctggtgctctgtgcatacagtacttgatgaaaaacgattttgggagattataggcaaactgaaagcactgggagcggagggaattttagtattgcctattgaaaagatgattatttaagcgagtctgtttgttgaacttttaattaaaaaaataatgaaactgattaaataccccgatagatcgcagtgggatgaaattctgaagcggcccgtactcaacacagaaagcctttttgatactgtacgtgatattattaatcgtgtaagagttggtggggaccggacggtgatggagtatgaagctatgtttgataaagccgaactcacttcactggccgttacactcgaagagattgaagaagctgaaaaagaggttcctatagaattgaaagctgccatttatctggctaaacgcaatattgaggctttccatgctgcacagcgttttgaggggaaaaaggtagatactatggaaggggttacttgttggcagaaggcagtagccattgaaaaggtcggcttatatatccccggaggaacggcccctttattctctaccgtgcttatgcttgcaattcctgccaagattgccggctgcaaagagattgtactttgcacaccacctgacaaaaatgggaaagtgcatccggcaatcctttttgctgcccatctggccggagtcagcaaaatatttaaggtgggtggagtacaggccattgcttctatggcatacggaacagagagtattcctaaggtttataagatatttggtccgggaaaccagtatgttacagcagccaaacaacttgttagcttgagggatgtagccattgatatgccggccggaccttcagaagtagaagtgctggctgacgaatctgctaatccagtgtttgttgccgctgatcttctgtctcaggcggaacatggagtggatagtcaggctgtgttgattacgacgtctgaaaaattacaaacggaagtcgtatatgaagttgagcgacagttgggctatctgaaccgccgcgacattgccgagaaatctttggccaacagtaagttgatattagtgaaggatatggatgaggcgctggaattgactaatgcttatgcgccagaacatctgattattgagactaagaattacatggaagtatccggacggatcattaatgccggttctgtattcttgggagccttctctcccgaaagtgcaggtgattatgcttcgggaactaatcataccctgccaacgaatggttatgccaaagcttatagtggggtaagtctcgacagtttcatccgtaaaattacctttcaggagatacttcctgatggaatggctgctattggtccggctatcgaagtaatggctgcaaatgaacatttggatgcacacaaaaatgcagtaaccgttagattaaaggagataagaaaatgagaacattgcaagaattaacccggtcgaatatctggaggctaaaaccttattcttcggctcgtgacgaatataacggagcggctgcatccgtctttttggatgctaacgagaatccctataacttaccgcacaatcgttatcccgatccgatgcagcgggatctgaaatcggagttatccaaaatcaaaaaagtacctcccgcccatatatttctcgggaatggcagtgatgaagctatcgacctggtattccgtgctttctgtgaaccgggtgaagataacgtagtagccattgatcctacatacggcatgtatcaggtttgtgccgatgtcaatgatgtggaatatcgcaaagtgttactccacgatgatttccagttttcggctgaagagttgttggcggcggcggatgaacggacaaagatgatttttatttgttctcctaataatcccacgggaaacgatctgcttcgttctgagatagtaaaggtcattggcggattcgaaggattggttattttggatgaagcttacaatgacttctctgaccaaccgtcattcttatccgagttggataaatatccgaatctggttgttctacagaccttttccaaggcatttgggtgcgcagccattcgtttgggaatggcctttgcttccgaagggattatcgcaatcctgaacaaaattaaatatccgtataatgtgaatcagttgacccagcagcaagctatagagatgcttcacaaatattacgagatagaacgttgggtaaaaacgttgaaagaggagaggggatatctggaagaagcttttattgagctgccttgcgtgttacaggtgtttccgtcgaatgcgaattttttcctggcgcgtgtaaccgatgcggtgaagatttataactacctggtgggagagggaattattgtacgtaacagaaattccatttcattgtgtggtaattgtcttcgtgtaactgtaggtacacgggctgagaatgccagactgattggagcactgaaaaaatatcaataggaaaaatgaaaaaaaaagtactgtttatagaccgtgatggcactcttgtcatcgaacctcccatcgactatcaactcgattctttggagaagcttgagttttatcctaaagtctttcgtaatctgggatttatccatagtaaactcgactttgaatttgttatggtgaccaaccaggatggactgggtacttcttcttttccggaggagacattctggccggcccacaatctgatgctgaaaactttagagggagaaggtattacgttcgatgatatattgatagaccgtagtatgccggcagatcatgcacctacgaggaagccgcgtaccggtatgctgactaaatacatttctaatccggaatatgatctggaaggcagttttgtcataggtgaccgtccgacagatgtcgaacttgccaaaaatttaggttgccgtgctatctatcttcaggagaacactgacttattgaaagaaaagggattagaatcctactgtgtccttgctactacagactgggaccggataactgaatttctttttgcaggagaacgaaaagcagaagtgcatcgtacgacaaaggaaacggatatttgggtagctctcaacttggatggtaatggtgcctgtgaaatttctaccggattgggctttttcgaccacatgcttgagcagatcggtaagcactccggcatggatctgagcattcgggtgaagggtgatctggaggtagacgagcatcataccatagaggatacggccatagctttgggcgattgtatttatcaggcgctgggcagtaaacgtggaattgaacgttatggctatgctttacccatggatgattgcctttgccaggtatgccttgatttcggaggtcgtccttggttagtatgggatgccgaattcaaacgtgaaaaaataggagagatgcccactgagatgtttctacacttttttaagtcgttgagcgatgctgccaagatgaatttgaatgtcaaagccgagggacagaatgaacatcataagatagaaggtattttcaaagctttggcccgtgcactgaaaatggcattgaaacgggatatttatcattttgaattgccatccagtaaaggggtactgtaaagaattaaggattatctttgcttttttaattataaatcccccttttgtaataaatgcacgtttattataaaagggggatttatgaataactctgtaactttccttatagaacgttttgtgtaagctgaaaaagaaggatctctatttctttttcacgaacgagtccggataggtgcagacatttagcttttccgtattttctttctcacgaagccaagtgtcgaattcccgtttaccttctttaagaacgatcatacggctgccgggtgttttgtcaccataagtgtttttaccgcccgaagcgcgtccgtaccccaaagcgatattgtaaagtgtagcgatgtagtcgttcacatggtcatgaccggcaaaaattcccatcacatcaccgcattccagcatctgggtaaacattccgctatttatgtttgggctgcattctttctcgttgcggtcgccgtatcgtttggtatcaaatgactcccatgcttgagtatattccggcaatggaatatggaggaaagctaatgcgggcagaggttgtcctccgttctgctcggtatatttttggctttcacgggtataccagttgatttgtgattgtccgatccaatcgtatcctttcactgttttgagttttgagtaggcattcgtgtccagacagtagagcagtgcagctacttttttgttatctgccgaaccatagattgggataatgtgattaccttctcccttaataccttcagcgatgttttttatcatacaataaggttgttgctggatgatacgtataatctcatcccgttttactgcatattcatcatcgtggttacccaagacggcagtccaggggagctggcgagtggcgagttcgccggctatggcttcccatgcctggctgacctcgtccatcgtggtaatgtctcctgtgaaaaccacaagatccggcttttcagagtcaagtacttcttttatcatgtctgctacaatcatgtttttttcctggtcatgtcccaggtgcatatcggtaaactgtgcaatcttgaattctccgttcttattgaagtttattttttctggagcctgttgtgcctgtccgcataagcttgccagtagcagtgcactgcttagaattatttttttcatcgttataacttttttgaatttgggttagtcttttttttgccaccaggtggtttgattgattttatcatttcctgtaccaaactgccgcatgatggccgcttctacgttagctccgttgttgtcgtactcaccttgcggatacatccaacgtttagggatctctgttccggcaggccggcggaagtccgggtaaccggtgcgcaattgttcgtagaaagaatcccagttgccttgatagaaggttacaaggtacttttgcataatgatgcgctctatctgttcgtctacgttggcagctttgccgaaggcgaccaaaggttcctgtaagtatcggttgaccgcatcggcattgagataagaggcgtaggctttggcatgtgtttcataaaaggagaaagaggcacggataccattctcataatatgtttgcgcattgccattgatccatcctcgtacgacagcttcggcgagaatctgttgcagttctgcataccccattaacatggttggttctacaatagggtctgtgcggaaacggtcattgataggtgatatggttccttcacttactttaatgatagcatcactgtaaggagctgccgggtcacctccttcgtaagagctgaaatcgtcgatggcctttccttcagtctttcctttattggtttgtgcgctgaagataaaaagccgtggatcccgacgttcacgcattcgttggataaaagtatcatccatgtaatagccggaccattgtgcgttaaattgagggtatcgattcccttgttgatccagataaaccagctgcccgttgtcggtcaggctttccattagtgggctgcctgttgcaatggccttgaattcggaggcaatattaagattccccacagtcgtatggttcgaaagagtcatcagtactttcaaccggaaagaattgatcagctttctccattgattgccattaccattgtaaataatatcaccatcaattacagaggcgtcatttgccagtatttcatctgcctctttcagttcttgaaggatgcccgtgaaaacatcttcctgagtatcgtattcaggagtatagatctcttctttttctccttttaaggcttggcggtaaggaatgtccccaaagcgtaaggtcagttcgtagaagtaataggcacggaagaatttggtaagcgccgtatataccggagcgttcacacgttcggcttcttcacccattttttgtacatttctcaggttatcgtagtagccaaagcttccccgtgtccatttgtagtattggtcggcactttctccgtcagtctgaatcacttttttagtagcatacattccgtcggttcctcttttgaatgcattcatactgatttgtgtcagcaaaagtttgggatgggtttgagtggcgttgtccggatctatattcatcttttccaagtttccgcaggatacgcacatccatatggatgccataaataataatatctttttcattttataaattcttattggtttcataacatgtttagaattttatgttgactcccataccgatatagcgtgcagtaggatcgttggcccctccgtcattgctgtctcccgtatagtcaggatcgacgaaaggaactttcttccatacagcaagattgttgccgaagattgtggcagtcagtcctttcacgggactttgttttgaaagtaatttagtgaagttgtaggtcagggctactcggcgcaatttaatgtaactacggtcgaatacattggcaaacttcgcattctctttggatgacacataagcctgataagggtaattctgacaccattgctgccaatcgacggctgttgtattacgtctgtatgtacgggtatccgagatgacatttccgtcaatgtcacgtttcagttcacctccggttaccactacaccgttgggcacatataccggatgtccggctgcgtattgtgcatctctgtattcaacagactccggatgtttaccaccccaccataacttttcgctcagtacggaatagatgactcctttgtacgcaccatccagatcgacagacagggtgaagtctttataacggaacgtattctgcatacccatacggaagttggggtccagatgtcccagatattgtttgtaggcgtctttggtcggcatgccattttcatcgagaatcagttctccatcagcacttttttgccattgtgaaccgtagaatgcgtcggcacggtcgcctactttcaagtcaccgaattttttttgtccaccatatatttctgtcagcttctttatgcttttgctccagttcagggcaaattcccattggaaatctctattttggattgcctgtacgtttgccatgatttcccatccgttagtggtatattgattaccgttcactttacggctggtgaaacccgaagcattcgatatgttcaggtcgatgatctggttctcgtcaatcgtgtgataatatgtcaggtcgaaggagagacggttccggaaaaaagaagttgataaacctgcttcccaagaggtcgttttctggggtttgatgtaatagttcaccagagacgagggataggagatagacgggtttgaaccatagttggtatctttagtgtaggtagatataatctggtatggagacaagtcggtagaaacgactgcccatgagccatacattttaagataatccatgaatgtaggtagtttgacatattcagacaccattgtactgattgctacggaaggataaaagtaagaattgctgccttttgcgagagtggatgaccagtcattacgtcccgtcagggtcaggtaagcatatttataaaggtcgaggttgacagagccataaatactgcggatggatttctcgttccggttggcatcggtaatggatggtccttgggtgtttttgatactgtatacgaaaggaacgatcaaaccgtcggtagactggtactcttgacggtaatttcggtaaaatacagagctacccgcattcagtgtaaaaagaatatcgggagtaaggtcttgtgtataggtagccagtatatcagcatccacattggtctggtggtcattccagactttgtagtcgccttcacgtgagtcaccatagttcatgtaagttttgggaactttcatttcctgtagaattgtcttctgacgtaaggctgcgcgtccctgaatgttcaggttgggcaggagttgataattgagacgtagttgaccgttcactacatcacggttttccgactgctgaagctcttcggcggcaaaataagggttgttgtaccatgcgtagttatagctggcctggcgatatccctcctgtcccggaacatatttatgtttacggagttctttaccgttcacatcgtctcccatccatacaacaatggtgtacatatggtttttaggtccgtatccatagcgtggatagcttggagaaaccaccttgttatacgccagattggcgtcaagttgcaggttttgagcaagatcgaaagtggagttgaagttgacccctccgctgtgcatttgtgtagagggtacctgtcctttttgataagcatactgtccggttacaaagtagcgtgctttctctcctttataggcgatagagatgttgttgttggttactaatcctgtttgcaggaagtctttcaggttatcatgagatacccagtcgataggaactcgttcgtagcgtgatttgtcatcatattgagtccctttcacatctccccaccaagaaatttctttcccggtcactttgtctcggatggggctattccattgggctactttggtcccgacgtttagtttgggaccccatgtcatatcaccatctgagataccaccgtcggcaccgtcccaaaattcgtatttgccgttcgaaccactaccatattgatgctgtgtttcgggtaatacggcaaaaccggcagtaatcatattgttggtggaaaagttgatttccaacccttctttcttggctgttttgctggtaattaagatagctccgttttttccgcgtgaaccatataacgccgaagctgctgtacctttcaacacgttgacactttcgatgttctcactcgatatatcgaaaaagtccgtttctaccggaacaccgtctaatacaatcaaaggagtattaccgcgtaatttgaaacttggtgcctgaaaaataccggtcggattggctaccaataagccggctacttgcccggaaagtgcagaaccgacattcaggctgggagttgcattcaacacgtcactgttgatttgctgggtggtgtaaccgatctttttcttttgttgtttgataccgatagcagttactactacttcatctatagcctgtacatcgtctgtcagttcaacgttgatcataggattattgcttttcacttctttttctaccgtattgtatccgacgaaagagaaagtcaggatatcacctatggaggcctcgagacggtaacgtccgtctatgtcggtgaccgtaccgttcgttgagttttttaccatgattgtggcaccgattaccggtcccattttgtctgttactgttcctgttactttgattgtctgtgcaaaagcaagtgatgtgcacaaaaacatacaacaaagaaacagataaaatttactgttcataagttatgtactaatttagtgtttgggcatagcagatgccgggacaagagatttaccattgtccgaggcttgctacaagtataagtttacctattgaaaaagtttaaatatcggttagttttacgttttggaaaacggaaagaagggcggctgcatttttgcgattttgttgtaaagcgtcttcgaatgattcggtttcagagtcgaaagcagagatggctattttgagtacatttgtaaattcggcagttacttgttcctgccccattttgttacttttgagttctctgttcagttgtttttcgatagaacgtacggcattgtagatagtaggtttccgaatgacggtacgacgggtaggatcacccggaactacttcttcccttaccacatagatattcatgaactggttatagagataaccggcttcttgtccgaatttgtaattagttacattggccagtgcttctgccgatggctgtttaatggcagaatagaactcccatgttgtttttacgactgagcttacttccgctttattcttgttgtcggatttgtcatcatccggcactgaatttgcagcgttcagggcaatactggatacaaatagtacaaatgctaaaataaattgtcttttcataactttacctctttttaatatgacgttgcaaaggtcgcgacatcatattaaaaagaggtatcgtcattgttacaattcggatacttctttcaaccatgcagccgaactggcatcgcttggcatacgccagtcacctctcggactgatggagacacttcctacctttggaccatcgggcagacacgaacgtttgaattgttgattgaagaaccggcggaaaaaggtttgcagccatttttttatggtttcagcatcgtatattccgttgaatacggtttgtgccagaaagtatattttcgacgggcggaagccgaatcgcaggaaatagtacaggaaaaagtcgtggagttcataaggacctaccagatcttccgttttttgtttgatttctccattctcatctgccggtatcagttcaggactgataggagtgtctacaatgtccagcagggttattttagattccccgtcgacttcattttcagctacccattgtacaagatgttgtaccagtgtcttgggtatgcttgcattgacgccatacatcgacatgtggtcaccgttgtatgtggcccatcccaatgcaagttcagagagatcacccgtcccgattactaatccacagatttggttggctacatccatcaggatttgcgtgcgttcgcgcgcttgtgagttttcgtatgttacatcatgtacgttgaggtcatgtccgatgtctttgaagtgctggatacatgcttccctaatactgatttcgcgaatcgaaatccctaacgagttcatcaaagcgatggcgttatgataagtgcggtcggtcgttccgaaccccggcatggttatacctaaaatgtctttacgggataatcccagcttgtcgaatgttttgacgcatactaataatgccagtgtagagtcgagccctccggaaattcccactacagctgttttggctcctgtgtgtactaagcgttgtgccagtccggcgacctgtatggagaagatttcttcgcaacggttgttgagttcagctccttgtggaacaaaagggtgtgggttgaatgtacgggtaagattcagatctttactgttggtatattccgtagagactctgattgcttctttacccgggcaattggctttgttggcagcaaaagttgtattaatacggcgttcggcacggatacattctacatctatttcgctgataactaattgctcttccaggcagaaccgttcacttcgtgcaagcaggccaccgttttcgtatatgagtccgtttcctgcaaaaaccacatccgtcgttgattcgccgaaaccactggatgaaaaaacataaccggagaggcaccgtgcggattgctggctgatcagagaacaaagatagctatgcttgccgatcccttcatcgtcggcagaaagattaaaaatgatttcagccccttgcagcgccagtgaagaacttggaggaaccgtagaccaaaggtcttcgcatatttctattccaaaagttgtttctgctgtttcaaacaacaggttgttgcccatcggaacaatttgtccacacaaacgtacactggtttccgagacctgcaaagcagatgtaaaccaacgctgttcataaaactctttataattaggtagataggttttaggtactactcccagtattttgcctttctggatagcgactgcggcattgataatcgtggaattgactactaccggcatacccaatatagaaatgatgtccaactggcgggtattgttcagaatctgcattaacgccatttctgcttgttcaagcagaagttgctgggcgaacaaatctccgcaggtatatccggtaatacacatttcgggaaaagtaaggatctgcacccctttgccttcggcaatggcaataagaccctccagtctttctgaattaaatttgcaatctgcaacctttacgcggggaacagccgccgcaacttttacgaatccgtagttcattttctatcagggtttatcatttctaccggcaaaagtaggcattttaatcgaatctttgtatttttgtcaaatttgaattgatacattataatattaaatcgcacaaaaacatgaagaagatgcttatggctgccggaatggctgccgtgatgactgcttgcggcacaagtgcacagaaagcagccaccgatgccggaaacccttttctggctgagtattcaactccttttaatgttccaccgttcgaccggatcaaagtagagcattacaaagaggctttcctgaaagggatggaagagcagaaaaaagaaatcgatgctattgtaaatcaacgttcggttccggattttgataatactattgctgcattcgatcagagtggagagttattaaataaggtgaatacagtattttatgggttgaacagttgcaatacgaacgatgaaatgcagaccctaaacaaagagcttaccccattgctttcggcacaccgtgatgatattagtctgaaccctgctctgtttgctcgtgtgaaagaggtttatgaacgacgcgagcaattgggtttagataaagaacagaataaattactggaagagacttacaagaaatttgttcgtggaggtgctaatctcgattctgttgaccaggcaaagttgcgccagttgaatagcgagatttcaatgttgcagttgacttttgggcagaatctgctgaaagaaaccaatgctttccggttggttatagataaggaagaggaccttgccggattgccggaaagtctcgtggcatctgcagccgaagcagctaagtcagaggggctggaaggagagtggctttttactttacacaatccgagtgtgatgccttttttgcaatatgcagataatcgtgagttgcgtgaaaagatatttaagggatacatcaatcgtggcaataatggtaacgagacagacaataatgaaattgtgaagaaattggttactttacgtctggagaaagctaaactgatgggatatgccgattatgcttcttatgttttggaagaccgtatggcgaagaacgaggagaatgtgtatcgtttactgaatcagatctggactcctgcagttgcgaaagctaaggaagagttagctgacattcaggctgaaattaaaaaagaaggagctaacttcacccctgaaggatgggactggcgctactattttgagaaagcaaagaaagcaaagttcagtctggacgaaaatgaaatacgtccctatcttgaattgaataatgttcgtgacggcgccttctatgtggctaataaactttatggtatcactttttccgaaataaatgacataccaaaaccgcatgaagaagcacaggctttcgagtgcaaagataaggacggtagtcatctgggggtgctttatatggatttctttccccgttcaagcaagcgagcaggtgcatggtgcgggacttaccgctctcaaacctatcgtgacggcaaacgtttggcaccggtagtaacaattgtgtgcaacttcaccaaaccctcttcgggtcagcctgctttgctcagtgcagatgaagccagcactttattccacgagtttgggcatgcattgcacaatttgtttaaagatgtacgtttttatggagtatccggagtgccgcgcgattttgtagagctaccgtcccaagttatggaacattgggtatttgagccggaagtactgaaggtatatgcaaaacattaccagaccggtgaggtgattccttctgctttgattgaaaaacttgataagagtggcaagtatggacaaggatttgctacgaccgaatatcttgctgcttctttgcttgatatggattatcatgtgctcaaagaaattcccggagatatggatatcgttaaatttgaaacaactgtacttaaagaacgagggttgccgaatcagatacctccccgttatcgtactacttattttaaccatattatgaatagtggatatacggctggttattatagctatatttgggctgaagtgcttgatagtgatgcttttgaagcctatagggagactggagatctttttaatcaggaagtagcatccagattccgtcgctatattctcactccgggaggaattgacgatgctatgaatatgtataagaactttcgcggaaaggaaccgggtatagaacctttgttacggaacagaggattgtagattggcttatacagggcttttacattgtactataggggaagaaacaatcttccccttttattttttgctaaaaataaacgcagaaaatataaaaaatacaaataatagttattatatttgcagcggtttattgaaataaacacaaaataccaacaattattaactattaaaagaattagaaaaatgaaagagtacattgatgttttgaagaagtggaaagactttgacggaagagccagaagacgtgaatactggatgtttgtcttgtttatggctattttcgctattgttgcaggtattattgatggcattttaggtacagtttgtgtatttgtagggctttattatctggctatgctcctgccaatgattgctgttagcgtacgtcgtatgcacgatatcggtaaaagtggatggtggttgtttatcacttttgtgccggtaatcggtagcctttggtatctcttcctgactatccaggatggacagccgggcagcaaccaatatggtgaaaatcccaaaggagtttaatacgtacatattattgtcataagaaacggcatgcaaaagtcattttgtatgccgtttttctattttatcaaaaaaatatccgtattttgtttgcgaaaataaaagaactctttatctttgcatcagatttaaaattgtaatgaatacaattttgtaaaagaggaagaagatggaatcatacaaccgattattagagcataacattaaaccgtccatgcagcgtattgctatcatgaactatttgatggaacataggacacatccgtcggctgatgaaatatacactgcattatctccctctatgccaacactttcgaagacaacggtttataatactcttagactgttttcggaacagggagcggcacaaatgcttactatcgacgaacggaataccaattttgacggagatacttcacagcacgctcattttttgtgtaagcgttgcggacgtatttatgatttgaagtgccaggttgaaatgaaacaagtagaagggcttcaaatgaatggacatgaagtaagtgaaatgcattactattataaaggtatttgtaagaattgtttaaatgatatacgtattgactaattaatttaaaattaagacgaaatgaaaaagtttagatgtactgtctgcggttatgtttatgaaggtgacgcagctcctgagaaatgtcctttgtgtaaagctcctgcaagcaaattcgtagaagttgttgaagaagaaggtggtgcactcacttttgttgacgagcacgtaatcggtgtggctaagggttgtgacgaagaaatgatcaaagacttgaacaatcacttcatgggcgaatgtactgaagttggtatgtatctggctatgagccgtcaggctgaccgtgaaggctatcctgaagtagctgaggctttcaaacgttacgcttgggaagaagctgagcatgcttctaagtttgccgaactgctgggagattgcgtatgggatactaagacaaaccttgaaaagagaatgaatgctgaagccggtgcttgcgaagataaaaagcgcattgctacacgtgctaaagctttgaatttggatgctatccatgatacagtgcacgaaatgtgtaaagacgaagctcgtcatggtaaaggttttgaaggactttataaccgttatttcggtaagaaataaatcatatagatgattatagaaaaaggcttgtatctatacggatacaggccttttttgttaaactttcttttgaaatggggccgttaactgatgatttttttatatttgtatttcacttaaaagaaaaaggattatgaaaaaactacagtctttagtgtgttttcttcttttgtcaatgacaatttatgctgccgatcaggtgattcagctgcccaagcccaatataaatcgtagcggacagttaatgaaagcgttatccgagcgccattctgtccgtgaatatgcttcccaagctctgagcaacaccgatttatccgacctgttgtgggccgccaatggaattagtcgtccggcagagggtaagcgcactgctccgtcggccatgaatcgtcaagatgtcgatatctacgtagtccttccgcaaggtacttatttgtatgatgctaaaggacataagcttaacttgatttctgagggcgattatcgttcggcagttgcagggggacaggcttttgtcaatagtgctccgctatcattggtactggtcagtgatttatcaaaattgggagatgtgaaaaataatcgcactcaaatgacaggagctatggatgtagggattgtttctcagaatatttcattattttgttccgcagcgcgactggctacggttccacgcgcaacaatggatacaacccggctcagaagtgccttgaaattgaaagatggtcagattccgatgatgaatcatccggttggatactttaagtaattgataaaagggtatggtttgccaaagacggcaccatacccttttatcatgttttttattaaaactttatttctgtttcagcaaaaattcgtctattgcttttttataagtggctttatctgctgctccacggaacaattgaggttcgccttccatgggaataaatacaaaaagaggaatgcttgttgcattgaacagggcagccaattctttttctttatctacattcactttatatatcacgatcttcccgtcatactctttagcaagcgatttcatgataggggctgtcatgcggcaaggaccacaccaatcggcatataagtcgatgatagcaggtttatcacctttgtatttccactcttttgagttttggtaatcaaacacatcgttgataaacatctctttattcatcacaatgacttcaccgctttttgcttcctttttgttttgatttgtcttggctccatcgtttacagcaaacataatggtgctgatcatggccaaagctactaatgataatactttcttcattctttgtcttttattgtgtattgttcaataactcctttcagttcgctaccttggatcataccggaatgtctccagactgcttctcccgttttgaaaaggatgaaagtaggcactgcctggattctgtattttaccgccaagtcctcatgggtatccacatctatttttacaatgcgggctttttctcctatctgttgtttcaaatcttcaagaatcggtttcattgctttgcaaggtccacaccattctgcaaaaaaatctactaaaacgggactttgtgactgtatcaaatcttcgaatttttccataattttttcctttcttttgataaatataagccctcgtttagacagggcaaatatagctatttgttttattataataacagagaaaccccgattttgttcatcatatagtaaccttgcattcatcctcctgtaatctgaaaacaggatctttgcgtaacgaaaaaacaaaaagttatgcatttacgcacgtattatcccacagtagttctttcggatattcatctgggaacacagcattctaaaacagaagaggttactcactttttgaaatcgattaattgtgaccgcctgatcctgaatggtgatatcatcgacggatggcatttacagaaaagcggtttgggaaaatggaaagctaaacatacggacttctttaaagtgattatgaaaatgatggagaatttcggaacacaggtgatttatgttcgtggcaatcatgatgactttctggataatctggcacctttgaacttttataatgtccaaattgtgaaagactgcatctatgagagtcatggcaaacgttattatgtgacccatggagatattttcgatacagtgaccacccaaatgaagtggttggcgaaactgggagacactggatatacttttctgttgtggttgaataaagtttataacgcccgcagaatgaagcagggtaagccttattattctctttctcaatctatcaagaataaagtgaagaccgctgtttcttatatttctgattttgaaaaagagcttgtaggactggcaaaagttaaaaggtgtgatggggtgatatgcgggcatattcatcaccctgccaatatttattgtgatggtattcattatcttaattcgggtgactgggtagaaacactttcggctttgacagaagatgaagaaggaaactggactatccgttattttgatagtgaactattgaaagaaaataataacaaagagaaaaaaactacaccaataactaaagcatcatgaaatttttgtttatcgttcaaggagaggggaggggacattttacccaagccattactctggaagatatgttgttgcgtaatggacacgaagtagtggaagtacttgtcgggaaaagttcatcacgtactttacccggtttctttaaccgaagtattcaggcacccgtaaagcgcttcaccagtccgaattttttgcctaccactgagaataagcgggctaatctgaaaaagagttttgtttataacctgatacgtacaccggaatactttcgcagcatgtgttatatcgatcagcgtattaaggaaacaggggcggaagtcgtgatcaacttctacgaacttctgaccggacttacctacgcactcttccgtccctctgttccttatgtctgcgtcgggcatcaatatctgttcttgcataaaaactttgagtttccacggaaatctatgatccaactttccatacttcgcttttttacacgtttgacgagtctgcgtgccaataggcggttagcgctttctttccataagatgaatccggaccgggcagaaggtataaccgtcgttcctcctctgcttcgtagggaagtgactgccatccaaccggaacaaggcaattatattcacggatatatggttaattccggttttgcagatagtgtagaagcctttcatgtcttacatcctgaagtacctatgcattttttctgggataaacaggatgttgacgaggtaatcaaggtagatgctaccctaagtttccatcagattgatgatgtgaaattcctcaaccgaatggccggttgcagagcatatgccagtacggccggttttgaatctatttgtgaggcaatgtatttgggaaaacctgtactgatggtacctgcccatatcgaacaggattgcaatgcctatgatgcttaccggtccggtgccggaattattggcgaatcttttgatttggagtcgttgctacgttttgccgggacgtatgttcccaacaaagagtttattcgttgggcccgtagtagtgagcggcagattataggagaactcgaacgacttatcgaccagcagtcggtcattactgtacctacattaactaattattttccgatatgaaattgaataaaactgattatgtgcttgaacgtacatccgatggaggttattatgcctggcttactgtaagtatgcagtgtaatgcgtatggtgattcacctgaagaagcggtaataaatctggaacaaaccatggaagatatggttgaagagatgtatttggtagaagattttgtctgaagctatcaggtaatcagtgggagtgaagaattttattgagaaatacttccattgatattttaaagaaagagagtacactttaagtgaagtgcactctctttttatattattccacaatatcgagttctttgatgatatgtgaagcacctgcatatttatcaataataaatagagtatagcggatgtcaaccactgctgcacgttgtgaagaaggacggaaagcaatatctcctgtcaaaccttcataattacggtcgaatccggtaccaatcagttgaccttttccattgaataccggacttccggagtttcctcctgtgttgtctgtattgacaatgaaacatactggcatttctccgtttttcatagcgtagtgtccgaagtctttcgcctgatatagttgtttcagtttggtgggtactacaaactcccaattgccaggatcttctttctgcatcacacctttcagagtcgtatagtagttgtatactgttccgtcagcaggttcgtacggcaatatctgaccataagtcaatctgagagtcgagtttgcatccggatagataggtgtgccggcggcttggcgcatgtccatcatacctttcacccatactttgtgggcggcatcatagtttttattggcatctttcattgcgagagctgtttgcagcaatccgtctgtgatggagtatttgaagagaaccatccagtccttatcgagcttgttcagggtaggacgagcgataaacttgtcgaagttttctttcgacccgaagattgaatacttgaagcaagcatcgataaaggcattcttatctcctttgaaacggctgtttattactttgaaaataccgatctgttgatcttccggaatatatccggcataggtttcgagcatttttttgcctacgatttgttctacttccgggaaagggacagatgcaaaatatttatctgctgcaattttcagtttatcggtttcttctttaatttttgaagcatttttactttcaagcgcttttttcaatccgtcggttgaagggattttcataaaatcaagtgcagttaccaatgcttcgttaatagcctgttgatgatacatcgcatcatggcggtgagctacaatcgaacgtatttcgtcgaaggccttctggtaagaatcatctttcttctcacgtcccattgccaataactgttcttgttgcttttctttggtatccaacactttcaggcgaacaagcccttcgttcatgccaatggcatttttccagtaattagctgaagaggcatatttgcttgcgtaatgtatgcgcaccgcaggatctttcagcatttgttccatcagtacagcttgtcttgcttcgcgtacatgatggcgcatgaagttagtggtttgcatccgttcttttacttcgtcggcaatcatgtagcgccagttacgtccgggaaatcccataacgaaggtgaagtcaccctcttttactcctgccaaactaattgtcaggtgtttttttacttgtaggggcacgttgtctttagaatattctgccggctggccacttgggtctgcgtaaatgcggaataaagagaagtctcctgtgtgacgcggccacatccagttatctgtgtcagctccaaatttgccaatagaggagggaggagcacctaccatgcggatgtcgctgtagacggtctttacaaacagatagtacttgttaccgccataaaacggtttcagttccaggcgtgttgccggtgtgatttggattttttccgcctttgcgaaacggtcggcaaccgttgccagatatttgggagacaaataattgactccgttaggatcatcatcttttttgagctgttcatttacatagtccgttacgtcgagaatacggtcgataaaggttactgtcagtcctttgcatggtaactcttcgtttcggctcattgcccagaatccgtctgtcagatagtcatgatctacactgctgtgttgctggatcgccccatatccgcaatggtggttggtcagtaccaatccttccgctgagataatttcaccggtacatccgcctccaaaatgcacaacagcatcttttaaagctattccgtccggattgtaaacctcttcaatggggatttgtaatccaaggtccatcatggcagcttcattctgcgctttcaggtcagtaagcatccacattccttcgtcggcactgatggtcagtgccatcagtgcgaacgtagtagataataattgctttttcatcattattcaacaatcgtcatttcgttaatcaaatgtccgcatcctcccagtttttcaaggataaatagtacatagcgaatatccagattgatacagcgttgcaggttgttatcgaaattgatgtcgccactcagtgactcccagttaccatcaaacgcacaaccaatcagttctccattttcattcaataccggacttccggagttaccgccggtaatatcgttagtagacaggaagcaaacaggcatttcaccattcggtaatgcgtagcgtccgaagtcctttttctcaatcagctctttcagtttggccgggaccacgaactcacggtcttccgggttctctttttcaaggattccatcggttgttgtgtaatatttataatatacaccgtctttggggctatatggcttcacatttccgtaagtcagtcggattgtgaaatttgcatcgggataagatggtgtaggcaatttcatttcacccaatccacggatatatgttttatgtaataaagccagttcttccggcagtttgcccatctgtgcagccaggtcggtatatttatcaaatttagcacgtgagtattgtgtggctatatctttttcgattgcctttacagttggctttttgataaacttatcaaaattagactgatttgctaaaattgaagtatcatacattgcatccacgtatgcattgtagtctcctttatattctttttcaatcacctcgtagatagcgggacgctgtccggcaggaaccatctctgcataaagtggtagcaaagctttggctactttacgatctacttcgtggtcgtaatctttattatggatgttgtcaaacacctcttttaataccttgatgttagcctgaatattagagtcgtttttctgctctaacgcttctttcagtttatccatcaccagataaggactgccaaattcaataccgccgaagaatgtttcggtcaggcaggtctgctgatatttgatcggagaggtttttgatacggcttcattgatcttagatacaacctgcatatagtcagtgttatttttttctttggcgaattgtgcaaattttgcttcctggtctgctttcgtgcctaaaacattattatcgataatggctttgttcataccgatagaatttttccaataattgctggaacctgcatatttgttggcatattgaatacgtactttgtcgctggcattcatggcttctttcagtacgtcctgacgggtgccgcggatgcggatacggggagcattgcttgcttccatacgctctttcacttccgatacagtgaggtaacggctggtacttcccgggaatcccataatcattgcataatctccctctttcagccctttgatagaaatgttcaggtgctttttagttttcaagggtacattggaagcattgtattctgtcggttctccgttggcatcggcgtagattctgaacattgagaagtcaccggtatggcgtggccacatccagttgtcggtttctccgccgaacttgccgattgatgaaggcggggcggcaaccatgcgtacatccggatatactttcttataaaacatgtagaatttgtttccggcatagaaaggcaatgcttgcggaacgattcctttttttcctttcaggtcactcttttcgaacaattccttggccagtttattgagaaaagcactgctgaatgattctgtctcggtgatttcttttgcggcgattttggcatttacgatattagtgatgtcttctatacgttcgataaatgtaaactttaaccccggtgtaggcagctctttgtctcttgaggttgcccaaaagccatctgtcagataatcgtgttcaacagaactatgttgttggatagaagcgtatccgcagtgatggttagttaatatcaatccttccggtgaaatgatttctccggtacatcccccaccgaagatacctacagcatctttcagtgaaactccgttcggattatacaggtcttgggcttcaagtttcagtccctgttttttcatcatatcgatagagtgttgttcctgcatcagttgcagtaaccacataccctcgtccgcctttgcggaacaaacgaccaacgcagtcagcgccagtaagtaaagtttgagtctgttcattagtttattaaaaaattagtatgatttgttgcttttctattttaatctatgatcaatttgtttcctttgatagcgtccatcacattagcgggcggacgttggttcattagttcatttttcataaagtccatgtaaggagccacatgtttgaagaactgatgatatcctttgcacaggtagttgagccccggttcgccgtttgctgtgcggctgaagcgattcttagggcattcgccattgcaggcaaacagaaattcgcattccttgcattgggtgggcagtgaattctgtttcatttgtccgaaagacgtctggcgttcgctgtacatcatttctaccagagtctgattgtaaatgtttcccaatttgaattccggaaacacaaaatggtcacatgaatatacatcgccattgaactccattacaccggcatgtccgcaagtttttgccatagaacagacacccggttgttctcctacccagttggcaagcgttgagtcgaaaagttggatataatagttacctacatcttctttcacccactcgtcgaaaagtgtacagagaaagtttccccattgttcaggagtaacggagaattcagctatttttccatcttcccgttgtgtcagggatgccagatggcgtccgtctttatggggaaaaattcgttccactattggggcaaactgaatataatggcaatctaactccttgaaaaaatgataaaagtcgagcggatagtctgcattaaaatcgttcactaccgccatggcattccattctactccatgcttttttaaaagattgataccattcatgactttcacaaacgatggctttccaagtttgttctttcggtattcgtcgtgaaattcctgaggcccatctatcgaaactcctaccaaccaattgttctcacgaaaaaaatcgcaccactcgtcggttagcatggtaccgttggtctgtatacagttgtctatgcttcttccgcgagcatatttcttttgcagttccatcgctttcttatagaaagagagtggacgcatcaatgtctctcctccgtgccaggtgaagagtacctgcggcatagtttgcgaattgatgtattgttcgatgaacttttcgagtaattcatcactcatcacatgtttgggattttcttgataaagtctggacttttccagataataacaataatcacatgcaaggttgcatacagcccctacgggcttgagcattacgtatagcggcttggcaaagggtgcgtaggtagtagacattttctatattatacgattacaattttacgggttaacgggctgactaattcaataactcattgactatttgtcaactccgaaagtgcaaatttagataaagtaaatgaaaaatccgtccttatatagatgtttataaggattattaaagaaaagagtcttacaagttttaaatattgataaaatgtttcatttgcttacgaatccgttgtacctttgtcaccgaaaaagttgtgtatcctatgaataaagtattgccttttttacttttgctttttgttttcacttcttgtagccgtaagtataagattgaaggcgcctcttctgtaaccagcctggatggtaagatgctttttattaaagtgcttcagaacggtgagtggcttaatattgattctgcagaagtgatacatggattgttttcgatgaaaggcaaagtggattcggtagtgatggctacactttatattggcgacgagagtatcatgcctttggtaattgaaaaaggtaatattcaagtttcaattacaaatactgaattggttgcgaaaggcacctccttgaacaatgcactttatgcttttattgataaaaagaactcattagatatccagatagaagagttgcaacgtaaagaggcacgcatggtgatggatggtgctgacttggcagatattcatgaacaactgactcacgaaggtgattcgttgatgcaggatatgaatggttttatcaaaaaatttatttccgataattacgaaacggttttaggtccaagtgtatttatgatgctttgcagtactttgccttatccggttatgactcctcaaattgaggacatcatgaaagatgctccttattcttttaaaaataataaattagtaaaagattttattacaaaagcgaaatcaaacatggagctgattgaagagcatcagcgcatggaacaaaatgcaactttaaatcgttaaactttaagttttttccgtatttttgcgaaaaacttaatgaaaatgaacacgcacttacgatttagttatctttttgttgttttatttggtcttttggttgtatcatgtcattcgacaccggatacagttgtattatcattgtctcaagctgagagaataatggaatctgatccggatagtgctatgactattttaaagcacatcccaactcctgaaagccttcatggcaaagctcaagcagattatagcctgctaatgactcaggctatggacaagaattacatgaaatttacttcggattccctcattaaatttgcggttggttattatggatcttatactgaagatattgtatccaaaggaaaagctttctattattatggaagagtgatggaaagtcttgataaagtggaagacgctatgaaattttatttgaaggcgaaagatgtacttcaaaatactaagcagtttaagttgctgggacttgtgactgaaaagattggagacttaaatcgtaggcaaaaattgcttgatacagctctaaatgattataaagagtcctttgattattatgcttcgataccagattctttatatatgatttatgcttataggaatttgggcaggggatttttatataaaaatcaaattgatagtgcttaccattattatgataaagcattgtatatatcaaatcttaagaaatcttccgttgtgggatcaatacttttagaattaggagtaattcatcgttctgcgaaggattatgccggtgcagaacaatatttcttatcttttatagaaaaagaaaaagatcagggaaaattatattcaggatatttggctttgggaaatctgtatttatatatgaatagattgaaagatgcagagaaatatctagtattgtgtcttagaagttctaatcttattataaaaagagatgcatgtgaatgtttatatgatttggaaaaagaattgaataattttaaaggagccattggttataaagatatagctgattcattacaattactaactcaagatatagatactcggaacactatggctgatttgcaaagtaaatatgatagtgaaaaatggcagaaagaaagtttacaagccagtattgagaaaaagaacattctcttaatcggttcgtttataggctttattgctatattggttattgtatatatttattataaatatcgaactaatcagaagttaatcagagatattagccaaaggattcgtcagaatgctaccgagatagaaatgtatcaagagcaaatacatagttatagaaacttacaaaaagaaacattacgagattatagaaatcagataggagaattacaaggaaaagtgtctgttcttgaagatcagaatagaacattatctgttcatttagttgagaagaaggggaatataccagatagtgatgatggtgatctttatgctatctacatgcaaggacttcgtatactactaatgttgagagagaaagaggacatggaaaatgcctctgataaaaaacaacttttggatggtgattgggataagttatttcatctatccaatgctttacacaatgatttcattatacgtattaaaaaggaatttcctaatttgactaagcatgatatcgaaatttgttgcttgttgaaatttggcattacacatgaagttttgggactcgcttttctaacgacttctgagtcggtgacaaaggctaaaggacgtttgaaaaaacgattaaatttatcagtatccgatgatttggataatttcttgcagaaatattagttcaattttatgctggttgtccgggtatatgcctctgtttgtttgtgtaaattgcttatatatagtgatttatgtgatattaacccttgttgtatttgtccgggtgatttgttttgctatcttagccaaatgcgctatatttgatgaaaccaaaacaaataaaatatgaaattgcgtgttattttatcattgattgtggcattgttcattggacaatccatgtatgctatgtcaaatgaagttcttcgtagacctattatcttggatggagaaattattgaggaaggaaatcgttctatcaatccacttattcctatttctgcggatatcgatggttctaccttatttattaagttctcaaaggctataggtaatgtagatattgcagtgaaagaaattactgatgctaaaaaagaagtttattcgtcttctatggatgtaacagctgccagtcaggttacttcgttctctattgctgatttaactccgggaacttatgtgcttgaatttaccaatgcagctggtgggtatgtatatggacagtttattgtagaatagttgttataatgaagagaattttattatcaacatgcgacagaacgtatacgcaattaggtaatcaggaagccttggtttccttattgaaaggtgcggggtatgacgtgaactatacatcggaagtaagtgaacaagagtgggtaaattatcctttgattatcacttttaaagatgaagagtatgttcgtgttaaagaaatgaatttgcaaaacaatttgttgtcagtcaatgaattaatgggtgatacttgtttgttgccctctcatgacagatggacgaataatgtgaatgataatgaaaagaaatctattttgatttgggttaatgagtttcattctatattgagggtcttagctctgttgaaaggatattccacgtggagtactacgtctgtagtcgatttgaaattacgtgatttcactcgggttgtacaaactttccaagcgcagctatgccagacctccgaagtgatggagcatgcttcgaaggctgatttaatcataagtgatggacttttcgctgctcaagctgttttaaatcataagcctgtgattattgttgattcttatggttggaatggtttagttactgatgctacgtttatgagtcaatatgttgccggttttactgcaaaacctgttcagagtgatagagggtattttccattatatgatttatctattgcgataaataaggcatttgaaatggagcagtctgagttgaaaagttgctctaataaactcctacaggagaatgagtatatgtgtgagaaaattctaagagtagtttcatctcggtgttaacattgatgtaacactggattgggacttgtttttttatatagtactatcatatgtttttagtttaattgtttaatacttaaatggttgctatgtgcggggtgcgtgatgtatctcgcacatttttttattctgtatgcttttagggttcttatgaagaggaagaaattaataagatagtctacaaaaagttaacatcgtaattttatgaagttaacttcttgcaattacgatgttaatttcttgcaattacgatgttaacttcgtaaagttacaatgttaacttcctgtttttatgtggttttgtcatctaccaatatataacattcttcgttctttttatctgttatgatcgtatatttgcagttcgaagttacgaaaagagtgtaatttattggaaatgagcgtaggttaattgctcttgtcgccgtttttttcagagagttcatcccctcgggtcagaagacacgaggggatgacttgtttatagacgtaggaaaagaaggagggaggataacaaccgaactgatgcactcgtttataaataaagaactttactcttccggataaacaacatcccctgtcaatcattttatcagctttattcggaatgtttctggttaaaagaagctgtgtgagacagaaccctaatggcgaaagtcaaggaggctatgagaaaagcctccctgttattagtgataaatgaaatattatactctgctgtcagctccccacatcattttagtgcgaagagtgtcgaaaaagatgtgattaaagcgttttactactttaatgctatagtcagctctccggattgtgaggcgggttgtttccttacaggtttcgctactgccgtcaattgcaaccaggaaattgtggctacgactttctacatctaaagtgatttcccagtcatcacagatcactataggccttacgtttaaactgtgtggagcaaccggagtaattgcgatggttttggaatggggaacaatgataggaccacctacgcttaatgaatatgcagtggaacctgttggagtggcgataatgagcccgtcagcctggtaagtcgtgaggtgtgctccgttaatagcagtacggatactgatcatggatgaactgtcccgttttaatacggctatttcattgagcgcataaggtgaatcttgcaaatgtttgtcgtcacaaagcaattggagtacactccgttcttcaactgtataatggttctggtagatttcttcaatcgtttcttccatttcttccggggatacatctgctaagaatcctaatcgtccggtattgatacccaaaatagggattcctttgttacctacccgtcgtgccgcttttagaaaagtaccatctccgccgatactgatcaccatgtctgcatcaaaatagtcttcatcgaacaaattatccgccttgacgttcagttttaagtcggatttcaggaaacgatgaaattctctgcatacacagatttctgctccatgtttttcgagcaaattgaacaaagtagcagcatgtgaagacttcttggcttggtatgtatttccgaaaatggcaaatttcatgttgataaaagtttctagtgtgtcgcaaatttgggattttttttcggtattgctgttatcttatcgctaatatttgtacttttgcgcaaaacatatgggtaaaaggtccgtattatattaagacatagaactatgactaaattaagtgtgaacataaacaaagtggctacccttcggaatgcccgtgggggaaatgttccgaacgtggttaaggtggcgttggattgtgagagtttcggtgctgacggcataacggttcacccacgtccggatgaacgtcatatccgtcgttcggatgtgtatgatttgcgtccgttgcttcggactgaatttaatattgaaggatatccttctccggagtttattgatttggtgttgaaggtgaaacctcatcaggtgactttagtgccggacgatccttctcagataacttctaattcaggatgggatacaaaggctaattttgattttctgacggaagttttggacgagtttaacggggcaggtatccgtacatctgtatttgtggcagccgatgcggaaatgattgagtatgcggcaaaagcaggtgccgaccgtgtagagctatataccgaaccttatgctactgcttatccgaaagatccggcagcggctgttgctccttttgttgaagctgctaaagtggcccgccggttgggaattggtctgaacgccggtcacgacttgagtttattgaatctgaattacttttataaaaacataccctggctggacgaggtctctatcggtcatgctttaataagtgatgcgctgtatctgggattggaacgtaccattcaggaatataaaaactgtcttcgctaatgaatgcaatgctactattagcccaagtggctaccaacctggctgattccgttgcatcggccaaccctgtactgactcctgtatctgctccggctgaaatgaatatgcttgatatggctattaagggtggatggattatgattgttttgggagtactgtctgtagtttgtttctatatcctgtttgaacgtaactatgtgatccgaaaagccggtaaggaagatccgatgtttatggagaagatcaaagactatatccatagtggtgagattaagtcggcaattaattattgccgaacgatgaataccccttccgcccgtatgatcgaaaaagggattagccgtctgggacgtccggtaaatgacgtacaggttgctattgagaatgtgggaaatattgaggtggctaagttggaaaaaggcctgactgtgatggctactatttcaggtggtgctccgatgctcggtttcctgggtacagtaaccggtatggtgcgggctttttatgaaatggcaaatgccggaagcggtaatattgatatcacactgctttcaggaggtatttatgaagctatgattactaccgtaggtggtctgattgtcggtattattgctatgtttgcttacaactatctggtgatgctggtagacagagtggtcaataagatggagtccagaaccatggagtttatggacctgcttaatgaacctgcacagaaataaggtgctgagataaaatagagtgcgtagccaattggcacattgacatattggcatattgaagaattattttatggcattaaagcgtcgagcaaaaatatcacccaactttagtatggcatctatgacggacgtcatattcctgttgcttatcttttttatgataacctcaactgttgtgtcgcccaatgcgattaaagtgttattgccacaaggcaaacagcaaacttcggctaaaccgttgacaagagttatcattgataaggacctgaactattatgcagcgttcggtaatgaaaaagagcatgctttaggcttggaggaattgactccattcctgcaaagctgtgcggataaagaacctgagatgtatgttgctctctatgcggatgaaactgtgccttaccgtgagatcgttaaggtgctgaatatcgcgaatgagaatcattttaaaatggtgctggctacccgcccgccggaaacaaggaagaaatgaacataaaaagaaagagtgaatatataggggcgttgggtgcattgttggtgcatgtggctattattgctcttttgattctggtaagttttgctgttccacgtccggacgaagaagccggcggtgtaccggtgatgatgggagatgtggatgcggcttatggaaattatgatccctccactatggtggacgtggaagtaatgcctgaagaagtgccggctccgcaacccgtacccgaagtggaagccgaacaggaaatgattacgcagaccgaagaagaaacggttgctataaaacccaaggtcgagcctaagaaggagaagccgaaagtagagaagaagcctgaaaaaacagccgaagaaaaggctgccgaagctaaaaaacttgctgaagaaagggcagagcgtgagcgcaaggccgctgcagaagctgccagtaaacgagtagccggtgcctttggtaaaggctcgcagatggggggaagcaaaggtagtgctacttcgggtgaaggagtagaaggaagtaaagatggcaattcgtcgaccggagcaaagtccggagtcgggggatatggaacatttaatcttggcggacgttctataggagagggaggtttgccccgtcccgtatacaacgttcaggaagaggggcgagtagttgtttctattaccgtgaatccagctggtcatgtgattgctaccagtatcaaccgattgactaacacggtaaattcgactttgcgtaaagctgctgaagatgcggctaaaaaagcacgttttaatgccgtaaacggagtgaacaaccaaacaggaacgattacttattattttaatttgaaataattaatgcttaaagtaccgtgtttttagaaaggtgggctttgagtttataacatctaaatgatatagattatgggaacagtttatgcatttttcgcagacggatttgaagaaattgaagcgcttactacaattgatacattgagacgcgctggtttagatgtagaaattgtatctgttacgccagacgagattgtagtcggagtgcatgatgtatctgtgctttgcgataagaattttgagaattgtgatttctttgatgctgagttgctgtttttgccgggaggaatgccgggtgctgccactctggacaaacatgaagggttgcgtaagttaattcttagctttgcggagaaaaacaagcctattgccgctatttgtgccgccccgatggtacttggaaaactgggacttctgagaggtcgcagagtaacctgttatcccagcttcgaacagtacctggaaggtgcggagtgtactaacgagccggttgtcagagatggtaacatcattaccggtatgggaccgggtgctgcgatggaatttgcattgactattgtagatacattgttaggcaaggaaaaagtaaacgagctggtagaggccatgtgcgtaagacgttaagcctatgtatcggactgctttgattgtagccggggggaagggactccgcatgggaagtgaacttcctaaacagtttcttcccattggcggaaagcctgtattgatgcatacgttggaagcttttcatcgattcgataagagaatgcagcttattctcgtattgccccgggaacagcaggggttttggcgggaactgtgtgaaacgcatggatttaacatcaggcatgaaattgccgatggaggtgaaacccgtttccactcggttaaaaacggattggctttgataaacggtatcggtggtatggtgggggtgcatgacggtgttcgtcctttcgtatcgcaggaagtgattgcccgttgtttccgggaagctgctgtgcgaaaagccgtaattcctgtcatcgatgttgtagaaaccgtgcgccatcttacaggatcaggcagtgagaccgtaaaccgtaatgattataaactggttcaaactcctcaggtattcgatgccgatttactgagaagagcttatgaacaagagtttactcccttttttactgatgatgcctccgtggtagaggctatgggagttcctgtccatctggtggagggaaaccgtgaaaatataaaaataactactccatttgatttgaaagtagcttcagccttgttgtaatgttcgatttagctacacgagacataaagtacttatccggtgttggtccgcaaaaagctgcggttctgaataaagagttggagatttattcattgcatgatctgctctattattttccttataaatatgtagaccggagtcgcatctattacattcatgaaatagatggtaatatgccgtatatacagttgaagggaaagatacttggctttgaaacttttggtgaagggcggcagagaagattattagcacatttctcggatggcacaggagtcgttgacctcgtgtggtttcagggtataaagtatgtcacaggtaaatataaacttcacgaagaatatattatctttggtaagccgaccgtgtttaacggaagaattaacgtagcccatcccgatatagataatcccgctgatttgaaattgtcatcaatgggactccaaccttattataatacaacggagaagatgaaacgtagctttctcaactcccatgccattgaaaagatgatggcaaccattatcggacagattcaggagcctttgcccgagacactttcacctaaactgattgccgaccatcatctgatgcctttgacggaagctttacggaatattcattttccttctaatccggagctgttgaggaaggcggaatatcgtcttaagttcgaagagctcttttatgtacagctcaatattctgagatatgccaaagaccggcaacgtaaataccgcggttatgttttcgaaacagtcggtaaaatcttcaatacattttattctaagaatcttcctttcgaactgaccggggctcaaaagcgggttttgagagaaatccggcaggacgtcggttgcggaaagcaaatgaatcgcctgttgcagggggatgtgggaagtgggaaaacactggtggccttgatgagtatgctgattgcccttgataatggttttcaggcttgtatgatggcgcctactgagattttggctaaccaacattacgatacaatcaaagagttgttgtttggaatggatgtgcgggtggaactcctgacaggttcggtgaaaggaaagaaacgggaagctatccttgcgggactcctgaccggagatgtacatatattgatcggtacccacgccgttattgaagatactgtaaattttgcttctttaggattggccgtaattgacgaacaacaccgctttggtgtggcacagcgtgccagactgtggagcaagagtattcagccgccccatgtattggttatgactgctactccgattccacgtacgctggcaatgacactttatggtgatttggatgtctctgtcatagatgaattgcctcccggacgtaagccgatctctactattcaccagtttgataaccggagagaaagtttatatcgttcggtacgtaaacaaattgaagaagggcgccagatttatattgtatatcccttgattaaggagagtgaaaagattgatttgaaaaatcttgaagaagggtatttgcatatttgtgaggagtttcccgactgtaaggtttgtaaagtgcatggcaaaatgaaacctgccgagaaagatgcgcagatgcaactttttatttcgggtgaagcgcagattatggtagctactacagtgattgaagtaggagtgaatgtgcctaacgcttcggtgatgattatcgaaaatgccgaacgcttcggactttcacagttacatcagttgcgtggccgggtagggcgtggagccgaccaatcatattgcattctggtcactacctataagctgactgaagagacccggaaacgtctggaaataatggtacgcaccaatgacggatttgaaatagctgaagccgatcttaaactccggggaccaggtgacctggaaggtacacagcaaagtggtattgctttcgacttaaagattgcggatattgcccgcgacggtcaactcttgcaatacgtgcgtaatatcgcagaagaaataacggatgccgatccgggtggcgtgttgccggagaatgaaattctatggcggcagctgaaagcattgcgcaagacgaatgttaactgggctgccattagctgaaaaacggttaaacatgtagcttttttacataaacatgttgcataacatatttctctttatttcctctgtttatggaggtttagagaaatatttctttaattctgctatttatccttataaaaaatagttaagaggatacctgccgtttcgcttagaaatgctatctttggaggaattttaaaataaatgagcactttaaccttttgaaactgtacgttatgatggaaaaaacattggtcattctgaaaccttgtactcttcagcgaggactggttggcgagattactcgtcgttttgagcgtaaaggattgcgtttggcaggaatgaaaatgatgcagttgacagatgaagtgttaagtgagcattattcacaccttagttcgaaaccattctttcagcgagtgaaagattctatgatgacggctcccgttatcgtttgttgttttgaaggtgtggatgctattcaagccgttcgtgcattggcaggaccaactaacggacgtttggcagccccggggaccattcgcggagattatagtatgagctttcaagagaacattgttcatacctctgattcgccggaaaccgcagttgtcgaattaaacagattctttaaaccggaagaaatattcgattacaaacaggctacttttgactacctgtatgcaaatgacgaatattgattgaattgaattaaacaagacgaatgaatttcaattgcattaaaacagtaatgattgccgctgcggctatgatcagcctgaactctttttctcaggatttgattgcccgtcaggcaccgattgacagaaaattaaaaagtgtagattcattagcattgcagaaacagattcgcgcagaacagtctgaatatcctgcactgagtctgtatcctaattggaacaaccagtacgtacatgcttacggaaaggatgctataattcccgattcttatacaatcgatctcacgggcttccacatgcctactcccagtacccgtatcacttctcccttcggaccacgctggagaagaatgcataatggacttgacatcaaagtgaacattggagatactattgtagctgctttcgacggaaaggtacgtattgtgaagtatgaacgtagaggttatggtaaatatgtcgttattcgtcacgacaatggactggaaaccgtatacggtcacttatccaaacagcttgtagaagagaaccaattggtaaaagccggtgaacccattgccttgggaggaaataccggacgttcaacgggatctcacttgcattttgagacccgtttcctgggtattgccatcaatcctgcattaatgttcgacttcccgaaacaggatatcgttgccgatacatatacattcagaaaaacaagaggttacgaacgtaacaaagccggttcacatgatactaatatagcatcggacggcgaaatcagatattacaaggttaagaaaggcgacagtttgtccagaatcgctaaactgcgcggtgtttcagttagcacactttgcaagttgaatcgtattaccacgaagacaacacttcgtccggggcaagtattgcgctgttcataatagttatactacatagacggaagagggcactttaatattatttagagtgccctcttttcatttttctttaattattgttacctttgcacactatttgtaaggaaatgaaagataccaggcaacaatttgaacatgtcatagcattatgccgtgacctattctctaagaaactgcatgattacggtcctgcatggcgtattctgcgtcctgcttccgtaacagatcagatatttatcaaagccaaccgtattcgtagtattgaagtaaaaggggtgactcttgtcgacgaaggaatccgttccgagtttattgctattgtcaactatggtattatcgggttgatacaattggaactcggatatgcagagtcggctgatataacagtagatgaagcattggctttgtacgataagtatgcaaaggaagcattggaattgatgcttgccaagaatcatgattatgatgaggcatggcgcagtatgcgcgttagctcgtatactgatttgatactgatgaagatttatcgtaccaagcagatagagagccttgccggtcagacattggtatcagaaggcattgacgctaattacatggatatgattaactattctgttttcggattgattaagatagaatttgaaggataaggagctacatattattcagaaagtatggaccaatctgtgccgcttcgtgctggcaggggtgttcatcttttcaggattcgtgaaagcagtcgatccgttgggatcggaatataagatacaagattatctggatgctttcgggatgggaacgtggtttccggcctttttccctttgttggcgggtattgttttgtcagctgtcgagttttcggtaggtgtgtttctgttttttggtatccggaaaacaaccgctacctggttggctttgttgctgatgatctgtatgacccctcttactctgtatttggcattggctaatccggtatccgattgtggttgtttcggtgacgcttgggtattgacaaactggcaaacattttggaagaatgttattctgctgattgcagcaatttccgttttccggtggaagcatcagatgatccgttttatcagtgctaagatggaatggctcgtatctctatatactttcctgtttgtgtttgcgctttcgttctattgtctgggcaacttgccgatactggattttcgtccttataagatagggaagaatattccggaaaacatgagtatcccggcaggggcaaagccgacggtttacgagagtgttttcgtgttggagaagaatggtgaaaagaaagagttctcgttggaaaattatcccgatagtacctggaaattcattgaagcgcggaccgttgtgaaagagaaaggttatgagccttctatccatgatttctcaatgactaatcttgaaacaggtgaagatattacagataaagtattggcagataaaaactatacattcttattggtagcccatcggattgaagaggcagatgacagtaacatcgatctgataaatgagatttatgattatgcggtagagcatggttatggcttttactgcctgacctcttcgctggattatcagatagaacaatggaaagataaaaccggagcggaatatccgttctgcctgatggatgatattacgttgaaaacgatgatacgttccaatccgggactgatgctgattaaagaaggtaccattttaaataaatggagtgatagtgaattgcctgatgaatatgccctgactgacaaactggaaaatcttgaactgggaaaacagaaacaagagagcgatgtgcatacgatcggttatgtgctcctttggtttgctatccctttattgatggttttgggagttgatattctggttgtgaagcgtcttgaaaagaaacgtaaaaaggctgctgacaaagctgccggaaattcacaagtctcttctgaaacgcagaagaatgaataattgaatcgtaaatttattaacccttttaataaaaaacaaaatgagaaaaaacattgttgcaggaaactggaaaatgaacaaaaccctccaagagggtattgctcttgcaaaagaactgaatgaagcattggctaacgaaaagcctaactgtgatgttatcatctgtactccgtttatccaccttgcttctgtaactcctcttgtagatgctgccaagattggtgttggtgctgaaaactgcgctgataaagaatcaggtgcttacacaggtgaagtttcagccgctatggttgcttctacaggtgctaaatatgtcatcctgggtcactcagaacgtcgtgcttactacggtgaaacagttgaaatcctgaaagacaaagtgaaattggctttggctaacggtttgactcctattttctgtatcggtgaagttctggaagaacgcgaagctaacaaacagaacgaagtggttgctgctcagttagaatctgtattcgatctttctgcagaagactttgctaagatcgttttggcttacgaaccggtttgggctatcggtacaggtaaaactgctactcctgaccaggcacaggaaatccatgcatttatccgttctgctgtggccggaaaatatggaaaagaaattgccgacaacacttctatcctttacggtggtagctgtaaaccttctaatgcaaaagaactgtttgccaacccggatgttgacggtggcttgatcggtggtgctgctttgaaggttgccgatttcaaaggtatcattgatgcattcaactaattaaaagattaagaactggaagttgggaatgttggttataccaatcaatccattctcaattttcagttctccattcctcaattgacaagcttatgaagaaattgagcttactgtttttactattggttcttgcggcaggtgtacaggctcaaagcgatattgtgaagagtctggaacgtaatgtgccgggacaagggaaagtgaccattcatcaagatccacgcattgcagctttattgggtagtgttcctcccagtaccggtgaacagaagatactcaagtcttccggataccggatacagacttatgccggcaataatactcgccaggccaagaacgaggcgcataacgtaggctcccgggttaaggagtattttccggaactttccgtttatacctctttcaatcctccccgctggttgtgcagggtaggcgattttcgtagtatcgaagaagctgatgccatgatgcgcaagctgaaagcaaccggtgtgtttaaggaagtctctattgttaaagatcaaatcaatatccccctgtaattatgttagaaaaagaagaaatcaactctccggctttggaggatttaaagaagcattatcgcagtattatcactcttttaggtgaggatgccgaacgggaaggtttactgaagacccccgaacgtgttgctaaagctatgttgactctgaccaaaggttatcacatggatccgcatgaagtgcttcgttcggctaagtttcaggaagaatacagccagatggtgattgtgaaagatatcgatttcttctctctttgcgaacatcacatgctgcctttctacggcaaagcgcatgtggcttatattcctaacggttatatcaccggacttagcaagatagcccgggtggtagatattttctctcaccggttgcaagtgcaggagcgcatgacgctccagattaaagagtgcatccaggaaaccctcaatccattgggagtgatggttgtcgttgaagccaaacacatgtgtatgcagatgcgtggtgttgagaaacaaaattctgtaactactacttccgattttacaggtgctttcaaccaggctaaaacccgcgaagagtttatgaatctgattcgtcagagataagtctggtgtagtatattattggtatataggggcaatcgcgctgaatttattagtatttaagtttgtttatatagcttttgttttttatttttgtgctaaatgaattaacttttattttagcgtatgccctccaattccagtgacttaatccggttcaacaagttcttttccgaaaatcagcaacggtttatccggtttgcatggacttatacgcgtgacgagatcgtagccgaagatatcgttatggaggctttaatgtcctattgggaaaaccgtcttaagatctcttctgagatcaatccttctgcctatgtccttacggtcgtaaagaataagtgccttaatcatctccgccatttacaattggtcaatgaagtgtccgatcgcgtcagttctcattcagaatgggaattgtccaatcgtatcgccactttggatgcctgtgaacccagtgctttatttgccggagaggtgcagaacattatcgatcatgtgatttcccgtctgtccgccaataccgcccggatttttgttctgagccgttacgaaaataaatcccacaaagaaatagccgagataatgggaatgactgtaaaaggcgttgaatttcatatctccaaagccactaaagagcttcgtgtagctctgaaggactatctggtcttgttccctttcttatatgacttcctcacttaaaaaccattcagaaaaatgtattacgggtatccgaagaaggtactgcccataaaaaaagaacttttttactagggaggtaatctgtttgcgtgttattaagatgaatgcagataaaaacagacctatgaaaatagaaaaagaaatattatatcgctactttaacggggatgccggttctgaagaagaaaagaagatccgccagtatattgaagcttccgaagaaaactggaaggaatatcttcgggagaggaaattcttcgatacgattattctgaaggagcgggccgtttctgtccaaaagcaggccgggcgacgacggatgatccgtagaatcggttttgaatgcctgaaggtggtggctgttctgctgattgctttagggacaacgtatttctggcttaaccgaccctccgaaacagaatcgagaagtgtggtcagcactttgaagggacagatggcgaacatcactcttcccgacggtagccgtgtctggcttaactccaatacccgaattgagtatccgcaaaactttgcagataaaagacgtgacgtagagatagacggcgaagcctattttgaggtaacgcatgatgcaaagaaaccctttgtggtacatacttccgaaaaagaacagattgaagtactcggcacccggttttatgtagaagcctattcgggtaccaaggagtttgagacagccttgatagagggaagtgtccgtgtgaaagcaggcaattcccagttaacgctgcgtccttcgtacaaagccgtacttaaagggggcaaaatgactgtcgaaaaaatcactgattttgatacttaccgttggcgtgaaggactgatttgttttaagagtaaacggtttactgaaatactgcgagagtttgaaaagtattatggtgtcgggataggatttgatgccgccaaagtagacaatccggtacttactgtcaagttccgcttgtccgacggaatagaatatgcattacgtgttttgcagagggacgtgaactttaagtacgtccgggatgatgagaagaatacatttaccattaaataaattgttgaacctttaataagaatactgcctatgaagaataccgcttaaatctgattgaaacaaaaggccggtaagtactgcaatacctaccagcctaaaggagaaacattcttcttttacctgaaaaagaaaaatattaaatgaatttataaagcaaagatatgaaaaatactcgttgcacggatttttatgtacctaaaaattcgtcaatcaaaccattatttaaaactatgagagtcactacattcttacttttcttttgtgtattcggtgccatggcaggtactgtcaattctcagaatgcaagagtgtccattaaaaaaacgaatgtccctttagaggaaatactgaatgagatagaacgtcagacagattacctgtttatgtactcgaatgctgtcgatgtgaaaagacacgcatcaatccatgtttcagagaaacccgtatcggaggtcctgaatcagttgcttggaaatcaagtcttgtacgaaatggaaggaacacacatcattttgtccgacaagcacagcccccggaatacgataatcgtacagcaggaagacaaaattccggtgaaagggaagattaccgacatggcgggtgagcccatcataggtgccagtatacttgagaagggcactaccaacggaattataacagatctcaacggcggcttttcgttggatgtatctccgggagccatacttgtcatctcgtatatcggatatgccaaacaagaagtcaaagtgattcccggcaagactctgaagataaagatgaaagaagatgccgagttgctggacgaagttgttgtcgtgggttacggtacgcagaagaaagtaaacctgacaggtgctgttgagaccatcgagtcggatgtcattgaaaaccgtcccatccgtagtgccacggatgcacttcagggaacagtatcggggctgacagtcagttcgggtaccggaaagcccggagagtttgcctctttcaagatacgtggaaacacttccatcaatagcgccggtgctttagtgattatcgacggtatgccgggagatattaatgtggtaaatccacaggatattgaaaccatttcaatattgaaagatgccgcttctgctgctatttatggtgcacgtgctgccgagggagtggtattggtgactactaagaagggggcttcggagaaggtgaaggtagagtataccggtaatttttcttttaattctcctacgcgtttacctgaaagcaatacgggattggaccatgcattattatccaacgttgcatttgccaatgccggattggctgctcctttttcacagaaagcaattgatgctattaaagatcccaataccattgctattcctaacggtaaagagtggatatatacttcggatgtggactggattggtctgatgatggatcatagttttcagcagacccataacttaactatttcgaaagcatctgatcgtttgaagtatctcttttccatcggctggcttgatcagaatggaatgttttctgaatatggtcctgacaattatgaccgtattaatctccgctcaaatatcagtgttgaattgataaagaacaagctgtcgtttgatagccgtatcagctattcacggggagtaaacctctatcatgctgccgaaggttcgtggtcaattccttatatcacttttatacaggccggtcccaatatgcctatttatgatccgaatggaaattattcccgccaccgaatgcagttgaatccgattcaggccttgaaagaaggcggtgaagggcgtacccgtaatcaacggattgaaggagtatttactttagagtataaaccggtgaaaggtctttctctacgggccgtcggaggtgcgaatattcttgacggacaaaaaaaggaatggcgtagagcttatggaaaatatggtgtggaaggtttaatctcgactgcttttggacagaaaagcccgaactctgtaacgcagaacaattcccatcgacaatatctgaccgggcaactgattgccgaatacaaaggtgtatttggaaaacacgatattaatgttcttggaggatggtcggcagaagagaatctgtatgaagatcttcagggaaaacgtaccgatatcataggaaatgaactgcctgcgcttaatctgggtgatacggacggatggtcgaatggtgccgatgaaaatgaatgggcattggtttcaggattcatgcgtatgaattatgcgtttgcttccaaatatctggttgaggccaacttccgtgcggacgcttcttcacgtttttcaaaaaagcacagatggggtgtatttccttccgcttcggtcggctggcgaattacggaagagaagttcatgaagaatcagcgcattttcgataacctgaagttgcgtgtttcctggggacagttgggaaaccagaacgggttaggaatgtatgaccatattgccagttataatattaaggggtactatccgtttaagtcggaactcggacagtgggccgtcatttccaaactgccatcggaaacaagaacctgggaaacggtagaaatgaataattttgcggtagacatggcgtttctcagaaaccgtctgacagtgaccggagaatatttcatcaaacggaacaaggacatgctggtcaatgtcgaggttccgagtgtgattggagttgatgtgcctaccggcaattatggagaacttgaagtgaagggctgggaagtgaccgtaggctggcaagaccggattaaagacttttcctatagtgcccgtttcaacttatccgatcagaaagataagctcgtcgattacggagtggagtataacggatttgtggccggtgtcaatcagaaagttcagggatattctctggggtcaatcttcggataccgcaccgacggatatttcacgtctgaagaggaagttaagaattcggctgcttataataaatctattaccggtgtaggtgatattaagtatgttgataaagacggagatggtaagatttcagctcctaacgatctggaatatctggggaccaccactccgcggtatacctttggattgaatctgactgcggcatggaaagggttcgacctgggaatactgttccagggcgtaggcaaaagaaatttctatttgtcgagtgaggtgatgaatccctattatgctacctggaataacttctcctataagatgcacaatgattattggactccggagaatccgaatgcagcctttccgcgctattatgccggggccaatcataactatcagatttccgaccactggttgcagaatgcggcttacgtacgtctgaaaaatctgcaactgggatatacgatagacccgaaactgaccaaatcatggggcatccagcgcttgagagtctattttagcggcgataacctttgtgagtatagcaaactgaacgataacttcgatccggagctgtctaatgtagacggatatgtatatcctatcatgagaaacttttcatttggactaaacgtgacattttaattcttgaattatgaagatgaaaactatatatctttggttgctgactgcaatcgtattgtgtggctgtagcgatttcctggatcgggaacctaaaaccaatctttcacctgccagcttctggaagtcggaaagcgatttgagactggccaccaatgtgttttatcagaatatgaatcgttcgtatacattagataaccagagtgcggacggttttgctaacgtgagcaatcaagtcagttcgggaactcagagtccgggcaatacagatgctatctggactgcggcgtataagcaaatccggaatgccaataattttctggagaattatcagaatgccgaagtctcggatgccgtcaagaaccgttatgccggtgaagcccggttcttcagagcctatttctattttaatttagtgaagcgttttggagatgttccctatgtactgagcacgctcgatatggactcggaagaattgatgggccccgcactcctaaagaacaagtgattgcaggtatcatcgaagaccttgaatttgcggagacccacattccgctgaaaagcaaattgtctaccgacgtgggacgactgaccaagggagccgcccaggcaatgcttgcccgtgtggcgctctattgcggcacgagaaataagttccacggtgacggagagtataagaaatatcttcagatggccaaagaagccagtaagcggctgattgacacgaaagaatattctttgtataaagattaccgcgatctgttcctgcttcccggagaagactcggacgagcacattctttcatatcgttattctgctgaggccgatacatacaattcccgtatccgcgctacgatagccgatccctctcacacccctaccaaagtgctggccgatgcatttctctgtaaagacgggcttcctgtggagaagtctgcttataaagtagaatatctgcctgccggtaaggagtttgagaaccgcgacccgcgtatggcacttactctctggaaaccgggagatccgttcttgggaaaaccgtttgtacccaacctttcgagccagacacgtaccggatacatgttcaagaagtatggtgacgaagaatcttactcgaatatgaagtcgcggattgatgaaatactgattcgttatgccgaagtgttgcttatctatgctgaggcctgttttgaactggaagataagatctcggatgccgacctgaacctttccgtcaaccggctccgtgcccgtttcgaaggtcatcccgaccaactgcctgccttgaccaatgcttttgtagaacagcacggtttgagcatgcgcgaagagatccgccgggaacgcagggtggaactggctgccgaatcgttccgttacgatgacattatccgctggaaaacagccgaatcggaattaccggtagccatcttgggtgcgaagtttgactcggcgctttacccgacaactataccgggaaaagacgtaactttggataagaacggctttttgttggtacagaaagcagaaagccgtacatttgatgtttcgaaacactatctcttcccattgccgcttcgtgaggtatcgttgaatccggcattagagcagaaccccgggtggtgaggccggatgactgatatcgaggatatattccataaataaaaaagtatgtaatgaaaacaaatcgagcttttaaagaaatttgtgtgttaggcggcttggcatattccgtttgcggagtggctcaggagcgtccgaatattattgtttttctggttgatgatatgggactgatggatacttccgtcccctttctgacagatgaaaatgggcagccgacgcgccatcccctgaatgactggtatcatactccgaatatggaaagactggctaaacaaggtatttgtttttctactttttatgcgcaaagtgtaagttccccttccagagcttcaattatgaccggacaaaatgcgacaaggcacggtgtcaccaactggattaatgccgaaagcaataaccggactcctttcgggccgcccgaatggaactggaaaggtctcagggaagatatgcccactatgccgaaagttttgcagcaggccgggtataagaccatccatgtcggaaaggcacattttggttgtatgggtagcgaaggagagaatccgctgcatcttggttttgatgtaaatatcgccggttccggcataggacatcccggcagctattatggcgaatggggatatgggcatatcaaggggcaaaaggcaagggcggttcccgacctggaaaagtatcatgggacggacatctttctaagtgaagctctgacgatagaagcgaaccgggagataaccaaggcggtagaagaaaagcgtcctttttatctgaatatggctcattatgcggcccatgcgccttttcaggcagataaacgctttttgtcacggtataccgatccggataagagcgaacaggcaagggcgtttgctactttaatagaaggcatggataaatccttgggggatattatggaccaacttgagaagttgggaattgccgaaaataccttgatcttctttttaggagataatggtggcgacgcccctctgggagatgaacgcggatatggctcttctgctccgttgagagggaaaaaaggtacggagttcgaaggaggtatgcgtgttccttttattgcgggctgggcaaagcctgagaaagagagtaaagtgcagaagcgtttaccgattgaagcgggaggtatgcagacacagttggggacaataatggatatttatccgacagtgttggccgtggccggatgtaaagctcctcagggctatgcgatagatggattcgacctcaaaaagcaattaagcggtaaagtaaaccggaggcgtcccgagtctttcttgatgcactttccgcatgctcaccgtggcaactactttacgacatatcgtatgggggactggaaactgatttattattatcttcccgagaccccgcaacaaccgaaggctctgctttacaatctgaaggatgatcctgaagaaaggaatgaactctcttctgcgtatcccgataagtgtaaagagatgatccggaaaatgtctgaccagttggtaaaggaaggagctctttatccggtagataagcaaggaaatgaactgaagccctttgtctacttctgacaagtgaaggtttactgatacatcaagagggtgtgtcgagactcacattttttcgacgcaccctcttttttgttacaaactgtatgtgtatccgcttctttaagaaagagatgacggtgcataaccggatgtggtcagcgcaacaccacccggtcgcccaggcgtttggccatcaggttctgtatttccttcatctccttataccgttgcatgacggcgtcacattgagcgttgtcattggctatcgcaggatcttgcagcgcatacatgatgtgcttcagttcttctgccacgatggcattcttgaagttgatcatcagcattggaaccatttcgtacaaacgttcttcgtccgttaccagcttttgtgttttcgagtgatatttactcagttgataccggtcgcttgccagttcggtggctattgtgctgatagccggatcggggtgcgccacaaagaaacgttcggcggcgaactcctgttcgcggatatgttcggcggcttccgagaggatacggcggtgcagcgggttatggaacgccagttcgtcttctttcaggtcgttgatgacatactccaccactgtgaccggtacttcgttcccctcttcatccgtcatgttgcacatcaccctttctccgtagcggatgatcatctggatgataaggcgttcgtatttgtagaactcctgtccctctttgccctcctgagggataaacgactggtaggtatcgatttctgcctcttccggcggaaatggaggaggtatctcgcctgcttccggtaccggagcatggttggtgacggccggtttattccctttctcggcctgaagttcacggcgcttggccacttccgaaaccaacagtttgtcttctatccgcaataactgtccgcactctttgatataaacatccctgacgatggcttccggaatgaccgcgatgctgcgtacgatgtcgtttatcagttccgcccgtttcatcggatctttgcccgcatcctccatcaggagttgtgccttgaaacgtataaagtccgtttcgtgttcctgtataaagttctggaactccgtggcgttgtgtttccttgcaaaagagtccggatcgtcgccgtcgggcaagaggcatactttgatgttcattccctcttcgagcaacatgtctatgcctcggattgacgctttgattcccgccatgtcgccgtcatagagcacggtgatattgttggtgaaacggtgaatcagccggatctgtcccggtgtcagggacgtaccggaagaggccactacgttttccacccccgactggtgcatcgagatcacgtccgtatatccttccacaaggaagcagcggtcctgctttacgatggcctgtttggcaaagtagatgccgtaaagttcgttgcttttatgataaatttccgactccggagagttgacatacttggcgagtttcttgtttttcgtactgagcacacgcccgccgaacgcaaccactttgcccgaaagcgtgtggaccgggaacatgacacgtccccagaagcggtcacgcagtttatggtcgtccgtctcatagcaaagccccgtctttacgagaaactcttttttgaagcctttgcgcatcgcctcctgtgccagagcgtcacgcccttcggtgctgaaccccagttggaatttgtcgataatatcatcgcggaagcctcgctggcggaagtaagccagtccgatgctgcgtccgtctacgtggtttttcaggatgttctggaaatagtcgcgggcgaagttgttgacaatgaacatactttctcggttgctctgcacctctttctcttcattggtcagctcccgttccttgatttctatattatatttcttggccagatagcggagtgcttcggggtaggacatctgttcgtgctccatgataaagtgcactgcgttaccgcccttaccgcaactgaagcatttgcaaagtccctttgagggagacacgctgaacgagggtgttttctcgttatggaaagggcaaagtcccacgtagttcacaccgcgtttgcgcagcgtgacgaaatccgaaaccacttctacgatttgtgcggcatcgagtatacggtctatggttgcctggtctatcattgttttatctccttgcggatgcaaatgtacgtgatatttcttggataatcaaatggcttttcagtggattcggcaggccgtgccgatttatcggatatttgctttatgtcgcaaatacggattgttttgcattaaaaagtcagccaataaggcttttgtctggcggatacccgattgtttttgatccaacgggaggaagaaaaaggaaatcggcgggctttttcggttggagagccgggcttttgagtgggcagagcctttgtccggggtgaaaagagcctttgttttccgaaaaagacggttgcatttccaccgaaagacggttacattttccgaaaatgattacttctttttcaaatatctctatatgtttttcataattacatatattgttccgtttaagatccggattttccctgtttttctctctggttgcttgcccgtcccggaacttccttttctgccagaaaggtactctcgtcactcctgagtggataatatgatacaggaagagctctttgctgctcaatatgcttcttatatcgataaatgcgatcaatcggatcggaggaaaaatgaattagagccgttttttccttcttgcctttccctcaggactaaagaatgaaaactgagcgtttcttattatcattttgacattttgctcatcccgcaaataataaaagaaaggagaggggtgtctgtggtgaatgacaccccctcatacttatgataaagattcttatttaatcttttcccgtatcttcgtcagatactttttcattccttccgcatctttgctcgtgataatttcaagcaactgtttcagctctgtgcggatgttctctacctgtgacggtgtgcgcggattgaacaggatttcctgcaataagtaatcatcttcgctcaaaagcccttttgcaatagccatgtgcttcttgaatgtggttcccggggcctcctgatgtttcatgacagctgcgaaaacaaacgtcgaaacaaacgggatggacaaggagtaagctactgtttcatcatgctcgtcgaaggtatactcaaaaatattcaggttcaggctattgtataagtctttaaagaatactttccccaaatgatcgctctcactgatgatgatggcactttcgctgctcagattgctcaggctggcaaaagtagggccgaacatcgggtgagtggagacataacggaatccgctttcttcgtagaacttcttcagtccggttttcaccgaagcgatatcactcaggatacagtctttgggcaaaacaggcagaattttgcggaaagcgtccagcgtatacttcactgtggcagcattgatcaccagttccggttcgaactccttgatctcctccaatgttgtgaagcgatacgtgttgtacacaaaccgaagctgatgcgggttgacgtcgaacacggccgtctcgtgctggaaacttagtatgtcagtaaagaaggagcccatcttgccggctcccaaaattagaattcgcataatatgaatgatttgctatttattgataatctccatctgttgacgaaccgattcttcgtggatggcttcgaagatcactttcacaaactctgcactcatgccgcactgttcgccctgagcaccgcgtttctcaagaatctcgttatagcgtccggtctgaagcactgtgatgtcgtgttcttttttgtaagtaccgatttcgcgtgctacgcgcatacgttttgccaattcctgtatgatgttatcatcgcattcgtcaatctgtttacgcagtacgttcaggttctccgttgtctgtgtctctttacggatgacgagcaggttgaggatgtagtccagtacgtccggagttacttgttgtgaagcgtcgctccatgcacagtccgggttacagtgactttccactatcagtccgtcgaagttcaggtccatagcctgctggcagagaggagctaccagttcgcgctttcctccgatgtggctcgggtcgcagaagataggcagttcggggatgcggcggcgcaactcgataggaatgtgccattgcggcaggttgcggtacagcttcttgtcgtagctgctgaagccgcgatgaatggctcccagacgtttcagtccggcattgttgatacgttccagagcaccgatccataattccagatccggatttaccgggttcttcaccagcacagggatgtctacacctttcagtgcgtcagctatttcctgtacggcaaacggattggcggtggtacgggcacctacccacaacacgtcgatacccgctttcaagcattcgtatacgtgcttggctgtagccacttcggtagatacgtacatgccggtctctttcttcacctctttcagccaggcaaggccttctacgccgataccttcgaaacctcccggtttggtgcgcggtttccagattcccgcacggaagatttttactcctttggctgccagttgtgtggcggttgacattacttgctcttctgtttcggcactgcaagggccggctatcaccatcgggcgtttatcttccacgcccggcaataagattgattcgagttccatatcgatctaattcgtttagttgttatttcattattgatttgattcgttccaacgcttctgccaacttggcgtctttgcagcagagagagatgcggatgtatcttgctccgttgcttccgaaaataaatcccggagtgatgaagacgcgtgcctcctgcagcactttctctgtcagttcttctacatcggcgcaacttgcggggatttttccccagagaaacatgcccacctgcttttcgtcgtacgtacatcctaacgttttcataatctctccggccaggtggcggcggttccggtagttgacattgttgccttcataccattctgcatccgcttcgagtgctttggcagctgccagttgcatggcgcggaacattccgctgtcgatattgcttttcaccttcagaatccattgtacaaactctgcgttcgaagctaacatgccgatacgccatcccggcatattgtgacttttactcatggagttgaattctatacagcattctttggcacccggcacactcaggatactgatcggcttatcgttcaggataaagctgtacggattgtcgttcacaatcacgatgttcttgcggcgggcaaactccaccaggcgttcgtaaagttccggtgtggcattggcaccggtcggcatattcggatagttggtccacatcagtttcacgcggctcagatccatcttttccagttcatcgaagtccggcatccatccgtcctcttctttgagattgtagttcaccacctcggcacccagtattttgcttaacgaagtgtaggtgggatatcccggattgggtaccagtacctgttcgcccggattgacaaaagcgagtgtcacgtgcaagatgccctctttcgatccgatcagcggctgaatttctgttgccggattcagttccactccataccagcgtttataccagtcggcaaaacccttgcgaagttccggtatgcccacatacggttgataaccgtgtccgttcgggtcgtgagcattgttacacagcgtttcgatggtttgctccgaagggggcatgtccgggcttccgattcccaggctgattacgtctttaccttctgcgttcatccgtgccacttctttcagtttcttcgaaaagtagtattcgcttacaccgcccagtctgtcggccggcgctactttatacgtttgattttccttctgcatattcgcctaatattttaagttctttcgtcaatggagtgattgctgtaatcgattgtttgtatctcagataatcgttgaaagccacatctacgtagaactggtattcccattcccgtccgatgatagggagcgattgtatttttgttaagttgatattgtaaaaagataagatagacagaacctgtgagaggcttccttcggagtgggggagagtgaaaacgatgtttgctttgttgagaacggtgttttgttttcgtatctcgtccacctgccatggatctgccactaccagaaaacgggtgaaattatgtttgtttgtttctatgccttcttgcagtactttcattccgtaccgttcggcggcggcatgtgagcagatggcggcatgtcctttcaggttttcccgtttgatgatttcagcactcaaggccgtatcttcagcttctaccactttgatacgcgggtgttggttcaggaattcccggcattgcatcagggcgatcgggtgtgagttcacttcggtgatgtcattccagtcctcttcgggcaggcaaacgaagctgtgcgaaatgcgtaatttgtattcgccgataatctgcgtgccgctttggcgcaacagttcgttgttgtgcagcaggcttcctgcaatcgtgttttcaatggccagcatcccgattgtctgactatctttccggatggcagcaaacacatcttcaaagttggcgcaacagattaactctatttcttccccttcgaagtacttgtgtgcggctatatcgtgatacgagcccagtgttccttgaattgctattcttttcattcctaattgagtatatggtataaaaaaatcccgcgtccatgtcggagcgggattcatattattagtttctcttaatctcagttcttaagcaccctgtcacttgatacatacaaactcccgctctactttctggctaaagtaaaagtaaaaaaagaagtaatatgtaaaagtgaatacgttcataacgttttgctttatttctttgtttcaagggacaaaagtaatacttttcttttaaatgcaagcaaaaagccacttttttttcatgttttcttgcttttgcggtattaaaccgtcctatgcagcgggcggattacaatcccaatacgtttggagtagtctctgcctgctgattattgaactgtccgttcaggttctccccctctttcgggttcagttccagcgatttcttcatatcttctactgagccttctttgtcaccgttcagcagtttggcacgtcctctttcgtggtaggcagcagcaaagttcggattcaggtctattgcttcatcgaacagttcgatagccgcagacagtttcttctgtgtaatgaacaattgtcccagatatagataggcctgttcgttgaaagggttcatttccgtcacactgaggtaatcgttttcggcttcttcctgctttccggtggcttcttttattttgccacgtaacaggagggcagcttcttcgtccggattctgcgcaagtatggcttcaatatcttccatagcctctgcgaattgctgcattttgtacagtgcttcggcacgaagcagccgggcttccgtgaaatcatctttcagtacaatggcctttgtcagatgggcaatggtcattattccgttatccaatccatgattggctttacctaacaggtagtgtgccattgcgttaccctcttccaatgcgatggccttctgggcagcatcggccatttcctgataattttcttgcatgaagcacaggttggccagcgtcaggtacgtgctcgtcagttccggttccaatgcaatcatacgttccagcagttcatgtgctttcacgaactctccggtctgcatgtaaatctggctcagatagttcagtgtttcgaaatcctcttcgatggccagggcttcgttgaagcatttaatggcatagtccgggcgtcccatacgttgagcacgcaggccgtcatatttaaatatctcaaagttctttttggcgtttttctgtttttcctcctcagggttttctgttttacctgagaaaaaagatttaaagaagtttggcatgatcgatgtttttttagtttggttgcaaatgtagtaatttcatcacatacccttactgcttttcaggaagttttttcggtgagcaacccgttctctgaacttagcaagccctcgtccagcataaaccgtaccacttcgcccaactgttctttatctgtatttatgtgcgaagctatctctgccggagtcatcgggtggtctttcagcagggtcgttatttgttcctttagttcgttgaagctgctttgtggcacgtccggttgtgtgcggtggctgaggcagacatcacattgtccgcagttgtgttcgttcttctctccgaagtagcggagcaacatccggctgcggcagacattctctgaagtaacatactccaccatggcatgaatacgtttctcgtagcgctctttcctttcttcgtataccgcccggggaatctgcagataatgcaaatctacccgttcgcgcgtatatataatgtaaggtgtctttttatgcggaatgtagtcgacgatacggcgcttgctcagcatcaccagcaagtcgtaaatctgctgccgggtcagtcctgtgcgtaccgacaacgtttgttcgctgatgtaggcatagtctgtaaagacacccgtgtaagatcgcagaatcatttgtatcagtttctccgcaggctcacccatctcgcggagtttatacaactcatcccggcggatcgtgaagatgattcgtgaagcattgtcctgttcgtcggtatattccaggtatccggcctgtgtgagtatcttcagagcactgtcggcaggtacggggaagtatttgaatttgcggcaaaactcttccagactgaagtcatacatacatcccagtccgtcgcccatcgccatttgatagtggtattgcagatgttcgtacacatcttttatataatccttatccggaaaggtatccgcaatacgtttgttgagtgtcgttttatccgattttgcgtagagtatgactgcgtatgctttctgaccgtcacgccctgcccgtccggcttcctggaaataagcttcgggggagtcggggaggtccagatggatcacgatgcgtacatccggtttgtcaatacccataccaaacgcattggtggctactatcacccggctctcaccgttttgccatcgtttctggcggagatctttggttgcattgtctaatcctgcatgataaaagtcggcagtgattccttcatttaccagtagctcggtagtctctttggttttccgccgactgcgtacgtatacgattgcactgccctgtatccggttcaggatgtgaagcaattctccgtttttattatcggtgaagcggacaatgtatgccaagtttttccgttcgaaactcatacggaatacattttcccggcggaagtggagacgttcctgtatgtctttcaccacttcgggggtggcggtagcggtcagtgccagcaccggagcatccggcaccagttctctgatatctgctattttcaggtaggccggacgaaagtcatatccccattgcgagatgcaatggctttcgtccacggtgatcatgctgattttcattgaccggagtttggcccggaaaatctccgtatccagccgttcgggagagatatagagaaacttatagtctccaaagatacagttctctaatgccactacaatctcttgccgtgtcattccggaatagatggctaccgctttgattccgcgttttttcaggttctgcacctgatctttcattaaggcgatcagtggagtgatgacaatgcacaatccctctttggcaagggcaggaacctgaaaggtgattgactttccgcctccggtgggcatcagtcccagtgtgtctttgccattgccaatgctggttatgatgtcctcctgcaaatcgcggaaggaatcatagccccagtattgttttaaaatctcttgataagtcactctatcggcatgatatcttcaatctgcaactgcacttcccctcgtttgtgggtgttctcctcaatggtgtagcagatatcaaatgagcgtttggttttgatgtatcttacgtgcgaactttgtccgaaagcgattccgttcatcacgttgttcgatttgttatctaccagttccagcttgatatgttcctgatcgcgtccgaccactttgcttgttccataatcgtacacgtgatgtgtgcagaacaccggtttctgattatcgggaccgaacgggttgaatcgcttcaattcattgaagaatttcggagtgatgtctttaaagtctatttcggcatcgatatcgatcactgcgctggtctgttccggcagtatgtgttccgacacgaaactttcgaaccgttcggtgaatgcctgtacgttttccactttcatcgagagtccggcagcataggtatgccctccgaagttttcgagcaagtcgcggcaatgctcgatagctttgtaaacatcgaagccggataccgaacgtgccgaacctgtcgccatgtcatctgtccgcgtcaataccactgccggacggtagtaaatttctgtcaaccgtgaggctacgattccgatcactcctttatgccagtcttcattgtaaagcactatcgaacggcgatccactaatccttccagctcggctacaatcttattggcctcttccgtcatgcttttatccagatccttccgggtttcattgtattggttgatttgtccggctttctcaagtgctgccgagaaatccttctcaatcaacaggtctacagcctctttcccgttctgtatacgtccggaagcgttgatacgcggacctattttgaatacaatgtcgctcaccgtaatttctttctccgataatccgcatacatcgataatcgctttcagccctacgctcggattgctgttcagctgtttcagtccatgataggctaagatacggttttcgcccatgatcggtacaatatccgatgcaatgcttacagcggtcaggtcgagcaacggaatcagatgatgaaactcgatgccgttactgatggcaaaagcctgcatgaatttgaaccccacgccacatcccgaaagatgggtgtatgggtatgtattatccagtcgtttggtattcagaatggcaacggccggcggcaatacatcgtccggtacatgatggtcgcagatgatgaagtcaattcccttctctttggcatacgtaatctcctccactgctttaattccgcagtccagcacaatgataagtcccactcctgtctctgcggcatagtcaactccttttttggaaattccgtatccttcgttgtaacggtcggggatgtaatagtcaaggttcgagtagaactgttgaatgaacttgtagaccagtgccacagcggtggtaccgtccacatcgtaatctccataaatcagaatgcgctctttctttcccattgccatgttcaggcgttccactgctatgtccatatccttcatcaggaatggatcatgcaaatcgggcaattgtggacggaagaatttcttggcatcctgtgcctttgtaattcccctttgcaccaaaagttgtcccaggaccgggctaatacccagttcctgagccagtgcccggcttgtctctgcctgttcttgtgtaatgggtcgataattccatttgtgattcattttatatattgttttttctttttatctgttctcagatgccggaagtgcataactttccaacaagctgtaaaagtacgaaaaaaaccggaagtgaggggtatatactgaaaaaaataattgccattgtccgagatacaaaatactatttgcgcacattttagaaagatattaccgggacttcgaggcttttataccgatatgggcgagatgtccgggcattcatacgccttggaaaagagaagtgatgcaggaattgtccgaaagccaaatacaaatcggctggggcaacaatgcgttggagcagttgtccgattgtctttcataattctttatttcaacagcttacgattccgattattaccattttccaatatgctcatttgatggatagctatttggtttagcttaacaagacgttccctttgtgtcatattctgttcgataaacacagcatttagattctccatattcgacaaacagataagttcattgatagtagcataatcacggatatttcctttcagctcgggattcgcttctctccattgttttgctgtcataccaaacattgccacgttcagcacgtcggcttcattggcataaataatgcttgcttgtatcggtgtgacttccattggaataaggttttgctttatggcatcagtatgtatgcggtagttgattttcgacaattcacgtttcgctgaccaaccgagcagcctttgttcttctgtctttagccgctgatactccttaacaagaagtaattggaatttaggagaaatccacataccaaaatgatatgctatatcccgatgtgcatatgtaccgccgtagcgaccagccttagagtgaatcccgattgcactagtccgttctatccacgttttcaccgaaagtacaaaattattgcttcctgccgcatttttaattgtaccgaattcggtacaattaaaatcgggattatacaacatttcccattcgccaagatactcgatagtgcttttaaggctaagccaacggaagataatatgctcttgcagttggcttcttgccatgtctgtaaggctgatgtagtcttcttcattgtacttgacaacgctaatatctgtattttgaacggtaatttttgccattgtaattgatgcattgagtttcaatcacaaaggtcgctataatttgtgagactgcatcctttttaatggactatttacaaagataggatgccgttttttcgatagtaggcattattttccgaataattgttatacctttgtaaatgcaaagagttatttgacagtatagcaccgtaaatcgctgaaaattgcatggctgctaaatcgttacctctatatctcaaatgctccgttaaaagtttattcggttgagtccgaatccccgtgccatttgcacctgcttgtctgacaagtgatgcctcttttgagctgtcagccatttttcaatttgtaaatatcacaaatatggttcgtttattccagagatttctgtaagtttgtatcgtactattaagtgttatgattatgcaagatataataaacggacgttgcggttggtgcgggagtgacgaactgtatgtgaagtaccatgatcaagagtggggaaaattggtgaccgatgacaagacgctgtttgagtttcttgtattggagagtgctcaggctggcttgagttggataaccatccttaagaaacgtgaggggtatcgcaaagccttttgcaatttcgatgctgagtcggtggcacaaatgaccgatgaagatgttgaacggttgatgcactttgatggcattgtgaaaaatcgtctgaagatcaaatcgacaatcacaaatgcaaggttatttctcgctatacaaaaagagttcggtagtttttataactatacactgtcattctttcccgacagaaaaccaatagtcaacagttttcagtcattaagtgagattccggtatcatctcccgaatctgatgctatgagtaaggatatgaaaaaacgggaatttaaattcttcggaactacgatttgttacgcccacttgcaggcctccggatttatcaacgaccacctggcggattgtgtctgtcgaaaaagataaataacaatataactatgtacagtgatagaggatatcttatgccttttgcccgttaacattgttaatgccattttccgatggttttgttcttgtctgcaaataacaagtcttttgcatttaaagaatttgttatttgcagacgaaaaacgaactttaactctgtgttaaaacaaagcttttactgacagatattttgtactttgaatgtcttgtttttcagtttgttaagttcgatcttcacttcttagccttactgaaggtctttgcgggctataaccgatatacttgcttttttgtcaactataaacagagatcttgcactatccgtttatttcctttttgccttattcagtgccgcaatcagataccttcctttcgccccaatgtcactccagcaagtgttggcaatcagccgccacaccgttgttccctttcttccatagtccgacagcctgagaatggcgtttacttcgctcacctcgtttattcccaatctttttagcgtgtccgtcagtcccgagtaattgtgtgtcatcgtattgaaagcgtatcccggtatctgtagagaagcggaatcctccttcctttcttcctccttccccttggggggagctgaggggggaaattctttattttcctctgctttcttttcttttactttactttgtccggaattgcatgcattttttgcgttaacggctacatcatgtgctacattttcctgattaacggttacattttcaccttccggcgcttcatcttcctgcagagtcaagtttttcaccagcagatagggtaatgttttcagatccctttttcttcgctttgtcgcctccatccataccttctgtatgtttgccgaagtcagtattccgttttccagataactgtttctttccaatattcctttgatgaacaagatttcaatgatctcctgtacctccttggcttctacttctcttcccgccttgttggcaaagatcagacactgttcttcatcccaacggatgaagtatccctccttgtatattttgcacagcagtttcagtacgattgccgggccttttattccatattttgcttctatcacttccattgcgttctcttccatgaagtttacgcctaccgggaaatagttgatcccgtcgtatgctattgccatattgtttttatagattagttgttttttatctgtaatacttttatcacaaattaccccggattcccaaagacgttttcatttgattcctcgaaatagaaatcattcatctgtggaaatccgtgtaattctgtggtgtcggttctataccgtcggtctccattccatgaagttttccacttgaaacgtcgtccaccgctgttcgtccacattccagtagactacggcaccttccaccgtcgtcggatcatgccttttatggaattccgcttcgtagtggatcagcgttgccctcaccatccggaaacttccgtcctgttttcggtaagccaccattgcatgcccgtatcgcatgtggtccaacagatcttccagccgttccgccatccattccgcgcatggctctgagtatcctttctcaaagatgatgcgctttttccatttcagtctcagtgattcgctttgtgatgcgggtctttttttctttttcatacgtatatgatttaaagggttaatagataaattatcgccccaaagatagaccggaccgaatgtattccggtttgataaaattcattgtacgtatttcagcggatgccttccaagttgttgtcctctctttccacctctttccagatttcgttgacataagtcctgattgtcttgaaaattaatggtttaaatactccgtcccttattttcccaaaaagttctttctcctcgatgtagcgtgccaacgaatctttgcatgtcttgatattttgtgattctgcgtccgatatgtaggatcttatcaacgctttaataactccttcattgttggagataatccccggtatccgtgctcctctttttctgcctcttgtttctttaaccggttctgtgataggttgttgtactttcttattggcgtttttttacacttttgttcactgcctgtaataattcattttctttggtcatcagatcgtttatttagttaatatttaaatgatgttaagacgttgcaaaggtagaaagtaatccttcagtgggcaagtgaatgtggaattaaagggaaaacagaccttttttatctgttaattggctgatatatagcaaaataattgctgaaaaagtgggtgtttcaataaacgatcgtttaattgaacgcaaagatagagggtattttcataactgcaaaatgtttaataaaaaaagtatttttctttatggtttactccctttaaccatctgataatcaaatttctataaactaataaaaaacgttttaatatctgtctgcttttatctgtcttttaattatttggatttttaaaaaagtgtgtttcaaaagacgatcgtctattgaaacacttttgcttcataataggctcgtttacagattgtaagatcagtaaagccctgttttttcaaaactttgttttctgttcttctttttcaaaccgtctctcctgcgataggggagtacctgatgaaatgatatacgctgcaaggcaaacaacagaattagcaaacttgaccggaaggtatttcactaccccggtgtcccccaatcatatcctttcgtgaacaagagtattgataaatcctggtacgcccttcgtatcacctatagccgtgagcttgcctttaaggaatatctggactcccgtggagtgaagaattttcttcccatgcgctacgaatacgtattccgtggtgagcgtaagatccgcaaacttgttcctgttgttcacaacctggtttttgtttatgccacccgcagtgaggttgacgaaatgaaatccactgtcggggcttctcttcctattcgttatatcatggaccgtgagacccgtcagcccattaccattcctgaagtccagatgcgtagttttattgctgttgccggtaattacgatgaacaggttgtttatctggacccttctgccgtttccatgaagaagggagatcgtgtccgtgtcaccggtggcatcttcgagggagttgagggtgagtttgtccgtatcaaaggtgaccgccgtgtggtggtttccatccagggggttatggcagttgccacggccttcattcatccctctttaatcgaattaataaagaattaaaaactctgtgaactctgtgccctctgtggtgcatattccaatacgtaaataaatcaccatgttgtctttgcaatcagaaatcgattctttgtgcgccgtttcgcacgaacttctccatttaggtctggatggcgaacccatctattccgaccgtttccgtcagttgaatacggatgtgtatcatcgttgtgagcatcttttcggttcacatggacgtaccctcgaagaggaagcttctctttgtatcgctttgttgaccggctataatgctaccatttataatcacggtgataaggaagataaaatccagtcggtcctcaatcgtagttgggatctcttggatacacttcccgtctctctgctgaaatgtcgtttgttggtagcttgttacgccgaggtctttgacgaagagctagcgacggaggcacatgcaataatagacagttggaaggatcgggaattgacgagggaagagtttgagattgtggagcatttaaagagtttggaggaaaatccatatccgaatacggatatagaataatatcatttgtgaagtatttattttgttgaatagtaaagttatgttttggctgaggcctgtggcttcactataggtgatctatctatataattatcttcgtttcttaactattaaaattcagcattatgaaaaaacaatggcttgtattttgctctcttgaaaatcctcaagagacaaaaatcgcttctccatatttagattatcttacttggaacactaaaggatgttagaccgcagagtataaagacggtgtcttttatcattatgaaaatggtgataagaataaatgtcatatagattctatcttaaattatatatcggatacaggtgagaactggtagatgaagctaaagggtgatcatttcgttcatgcgccgaatggtgaccattcacgtgcgcatactgatacggtaatgcattatataggctgggatggtcgtaaatagagtgccgaacttttgactctgaaagataggtttcatcctaatctgacttccgattgtccggaaggtatgctccttaaagctgacaatgcggatgaggtttatctggttcaattgggtagtcgtcatcatattccgaatccggatgtttattttggcttattctcagcttaggataagatcgtggtaaagagtcctgaggaagtgaatactagtcctgtgggtatttctccttctttctttagacgcttgtctgattaaagctaatgactgatctagtgtatttgagtacgaatggtgtgaaaagtcatattaaatcggtagaagattttgataaggttggctttgattgggataagatccaagtgatgtttccggcagaagtggatacaatccctactgctccggaatatgagatcgctaattggtaatttatttgattgaaaataaaattataaggggagagaggatattctcttttccttttttaggactctctttatttttaatataattataacctgtttttccaaatactgggtctcgtatattggtggatatccgtatgagtaacggtgtttatatcagtcagaagaatttaagctacgcaggtttgagaaatctggtagagaaactggagggtttatgttgaatataacaggtttaaaccgttttttctttgttcgcaattttcacgatatacgttgtaaataagaagaggtcttattcatcattcatcaacagttaaatcgtgaaactgatgtcggtgatgtctttatcgtgatgtttaaagatttacgtctggtccgcttgttcggttatgatcaacggttttgcagcatatttgaaaaatgtttcaagcgtgggtacaaatttgtgtaggtaacttttagggggggaaaggatttatttaatcaataggaggctacctccgtcgcttttgaagacccatattcagatatgactcctgaggaaaaatcgaaaatgataatagaactgatggctgcccgtcagcgggatgcggaacgcatccaacaggacaaggctcgtatagatgaactattgtccaaagttaatgaacttctttctatgcagaaggcttttgtgacagcaaaaaaaacagttagacgattacaaacagatggttggtactcttttgtctaaaataacagcattggaagagaggttgaaagtctgtaacaagaacctttatgctagcaagagccaaaagggtattaataaaaagaagcgggaagccgaagaggaccacacacgtgacaaggataattttgacagcactccccaatccatcgaatcttcattgctgcagcatggcgatgatcctatgtgtgaagaaaatgcggaagcaaaatccaaggaggtttgtctttgtcatcaaggattgtcttatcgcaccatgggtgccgacaatacggtttgccataatagtgatattcgtcaactacccgcaggcgcaataatcatcaaacatgtccataaatatgcttatgaacagatcagcaagctggagaagaccataagttatataaatactttctggactcagttgtttgcttacttaaatgacggctcttattcaatcgacaattccattgtcgaacgatttatccgtcctttagccggtgagtgaaagaactcgttattcttcggaagcgataagatggcctgcgtctcagcggtatatcataccatcatctcaacatgtaagatgcagggtgtgtctgtgcttgattatttcaagagattcttcagtgagattgttaaaggacgtagggattatgaacatttattgcccttgacaatcggattgaactagtaacaaattttttaaattaatatcctttttgacgttatttattagaaaattgccttgtggcggcttttcttagggtatacgtcagaattggacgctaactattattatgcttaataacaaatccgtcttgattaccggaggaacaggttctttcggcaagaagtttgtggaaatcattctccgtgattatccgcaagtaaagaaaatcattatctactctcgtgatgagctaaagcagttcgaactgaagcagaagtattcggagaatcagtatcctcagatgagatatttcataggtgatgtacgtgataaggatcgtctcattcgtgcttgcgagggtgttgacgttatcatccatgcagctgctatcaagcaggtagataccgcagagtacaacccagaggagtgtatcaaaaccaatatccatggcgcaataaatgtgattgatgcggctatgattcagggagtaaaggatgttgtagcactctctactgacaaggcttgtgctcctattaacctctatggcgcaaccaaacttacctctgataagctcttcacagcagccaataatattaagggcagcaagaatattcgtttctctgtagttcgttatggaaacgtaatgggttctcgcggctctgttattccattcttcatcaagaagcgtgatgagggtgctgagttcttacctatcaccaataagcgtatgactcgtttcaatatctctcttgaagatggtgtagctcttgttatgtttgctctcaagaaccaccttggtggtgaaatcttcatacctaagattccttcttataagatctgtgatgttgctactgccattgctccaaacatgaagcaggttgaagtaggtatccgcccaggagagaagctccatgaggagatgattactgtaaccgatgctcttgatacaattgacctcggtcgttactatgcaatacttccttcagtttcttactgttggaatcgagaggactacctcaagcatcaccatgccaagatggttcctttgggatttcactacagttctgacatcaacgatgagtgggaaactcctgagaccatgcgagagaacatcaagaagtacgtagatccaaattttgaggttaagtaatcagaggagagagaataatgaaattgccaatctcatacggtcgtcagtatatttctgacggagatatacaggcagtagtagagacgcttaagtctgattacttgacctgtggacctaaaataccagagtttgaacaggctttctgtgaatatgtacacgcaaagtactctgtagcagtttgcaatgctactgcggctcttcatattgctgccatggcattgggtgttaaggagggtgataatgtcatctgtactcctatgacctttgcttcttctgccaattgtatccgtttctgtgggggtaatgttaagtttgttgatatcgaccctgagacttatctccttgatatcaataagcttaaggagattctgtttactgctcctaaaggcacttacaagggtatggtactcgtagactttgccggttatcctcacaatatggaggagtaccgcaaggtagccgacgaatacggcatgtggattcttgaagatgcttgtcatgcccctggagcatactttattgactctactggcgagagggtatattgtggatgtggtaagtattctgacataaccgtcttttctttccatccagttaagcacatcactaccggtgagggcggtatggcatgcactcaaaataaagagtactatgagaagatggctctctatcgcacccatggtatcacgcacgaggcagaaaagcttcagcgcgaggatggtctttggtattacgagatgcaggaacttggttacaattatcgtatcactgatcttcaggcagctctcggaacctcacaactcaagcgcgcacgcaagaatgtagaaatccgtcgtgaactcgtccgtaagtacaatgaggcattcgtaagcatcccagaaatcaaaaccccatacgaggccgctgatgtttatcatgcttaccacctttatgtcattcaggtggaagaccgacttggcctctataactttctccgtgagaacgggatattcgcgcaagtactctattatccgctcaatctcatgccgtactacaagcagtttggcaacaaggagggcgacctgccagtcgttgaggaatactacaagcattgccttgcattgcctatgttcccaaccctcaccgacgaacagcagcagtatgtaatcagtaaggttaaagagtttattttcaagtaaatgagcaatttaagtaaacttgttctcggtaccgttcagtttggactccaatacggaataaattctgctggtcgcccttcaatagaacaggtatcagacatactaaacaatgccaagacagggggtatcttgattttggatacttcctcagcctatggtaatgcagaagaagtcctaggttatgtaaaggctggcaaatttttcaagattgtcagtaagtattcagagtgtgataaatcgattgccgagactttcggcaactctctgaaactttttagtacagagcatctttatggataccttcttcatcattttgaggcttatcgtgagaataagtccatttggaatgatttcgttcagcttcagcaagaaggcaaggtagatcgtattggtttctctctctatgaaccttgggaactcgatctgattctcaaggatggtattcctttttcgctcattcaagtgccttacaatatcttcgaccgtcagtttgagccatacttcaagcaacttaaggagatgggtgtggagatacatgtccgcagcaccttccttcaagggcttttcttcaaggatagggaaaaacttcctgagaaacttcaaccgctcaaaaagtatcttattcagctcgatgaatatgcagtaagcaaaggtatctctgtaggagaccttgctcttaactacaacctccataatccatatattgatggtgtattgataggagtggacaacaaagaacagcttcttcagaattttgcttctgtaaaggatatagaaattaatcctgatataaaggttgaagaactggaattgttaaaaccggttaattggtaataatatgaagattttagctattacgcaggcacgttatggttcaacccgtctgcctgcaaagattcttaaggaggtgaacggacagacgcttctcgaaatccatctcaggcgcatccttcagtcaaaaacggtaagcaaacttaagattgccactaccgacgaagaaggttctaaatatattgtagaggttgccgataaggttggtgttgagtacttcaaaggatctgttgaggacgtactttcacgcttctacggaacagcagagacagaaaagcctgattatgtgatcagacttacttcagactgtcctttgattgatccaaatgttattgataccgtagttacattcgcactcgaacatccagagtatgattatgtgcatactgatgcaaaaagtttccctgatggtatcgatacagaagttgtgaaattttctgctatagagaaggcatataaagaggctgacttgaagtctgaacgagagcatgttactccttatgtctggaagaatggaacagcaaatggaggtaatattttcaagacgtacaattatccaaatcccgcaggtgatttcaatgcagatgactatcgcataactatagatgagccagaagattttgaggtaataaagactcttatcgagcatcttggtatagacaaggactggaaggattatattgactatctccttgaacataaggaagtttatgcaatcaatagcaagttttcaaacaatgagggttatgccaaatcacttgctaacgattcagtaattaataaataaatattcagtacaatgggtaaaggacaagagctttacaaaaaagcaaaaacgttgatccccggggggacatcgttgttatcaaaaagacccgagcagttgttgcccgagaattggccggcatattatagcaagtcaaagggatgtcgcgtatgggatcttgacggtcgtgagtatatcgactgcggtcttatgggtgtgggtaccaacacacttggatatgctcgtgaggaggttgatgaagctgtgatgaaggttgttcgtgatggtaaccttactactttcaactgtcctgaagaagtttatcttgcagaacggctcatcaagatgaatccatgggccggtggtgtacgatacacccgtggtggtggcgaagccaactctatgtgcatacgtattgcacgtgcctataccggtaaggataaggtggcaatctgtggctatcacggttggcacgactggtatgtatctgtaaaccttggcgaaaacgatgcccttgcaggacaccttctccctggcattcctacagcaggcgttcctaaaggactccggggctcttctataccttttcattacaacaatttcgaagagatagagaacatcattcgcaatacgcctgatcttgcagctgtcaagatggaggtttgccgcaatttcggtcctgctgagggttatcttgaacatattcgtaatctttgcaacgaatatggtgtaatactcattttcgatgaatgttcttcaggtttccgagagacatttggcggacttcacaagaaatatggtgtttatccagatatgaccatctattctaagactatgggtaacggatacgttattgctgcagttcttggaaagaaagaaataatggatgctgctcagggttcctggattagttcaacattttggaccgaccgtattggaccaactgcagcacttgctgcccttgatgtaatggagaaggaaaagtcttgggaacagattaccgcaaaggggctgcagaacaaagaacgttggcaggcactagctgataagtatggtttgaagataaatcaatggggtattcctgcacttgccggttacacattcaactctcctaatgcccttgcatacaagacttatgtgacccaggagatgcttaagaagggctatcttgcaggaacaatcatgtacacttcacttgctcatacgcaggaaatacttgatggctatttcgaggctcttgattctatttttgcagatattcgcgactttgaggatggcaaagatgtaatggaggctctcgaaggacctgtatgtcaggccggttttaagcgacttaactaatttcaaatgactaaacgaaagatcttctttcgggcagacgcgggtgtgcggataggttatggacatttcatccgtacccttgcgcttgccgacatgctccgagacgattttgattgtacattcttcactcagtctccctctgaatatcagcagagggagactgagaaagtatgttctctcgtagctttaccatccgacaatagcaagttcgaaaagtttctagactgtcttaaaggagaagaaatcgttgtacttgataactatttctacacctcagagtaccagaaacagatcaaagagaaaggatgtaaacttgtttgcattgacgatatgcatgacaagcattactatgcagatgtggtaatcaaccacggcttgactgatgggagattctttgacgtagaaccttacacgcacctgtgccttggtctcgactatgctctacttcgcaaaccttttattcaagcttcaagtaccgctaaaaatcctaatagttggtttatctcatttggaggaacagactattttaacttgacagaaaaagcattgcaggcaattcatgatgttccctgtgttgaaagtattactgtagtcattggggatgcatacaaatataaggataacctgaagaaatatccgaaggcaacaattatgaagaatttgactgcggaaaagatggcagacgtaatgcgtaagtcacaatatgccatattgccatcaagttcagtctgtatcgaagcattagcgtgtagatgtaaagtcgcgagtggatatttcgttgaaaatcaaattcaatttgcgtctattttaggtcttcaacgatacgttctaccgttaggagagctaaacaaaatctcatataatggtattgtcgataatattaatgattacgattttgtaaatataacaagttttacgaaaatccctcaaaggtatattaatacttttaaaatgtttttaaaatgaggtttccagaagaaattaatactgagcgtttccgttttgtgaattatacaaaactttcagaaatagaattgcaacagatacttaatatgcacaaccaacctctcagtcgcttgctggatggaaaacactgattccatattttggaatgaccatttagcttttatacagtcgctttgctcacgaagagacgaggtatattatgcagtatttgtaaatgctatttgggatatttaatggggctgtataaatataaacaaacatgcagattgacaggacgaataccattgaagtagggctttactcctacaagaattttgtgacattaaacaagcggcagattgactcggtatgggaatggagaaatcatcccgatataagaaagtatatgtataatagtgatataatttcttatgaaaaccatttgagattcttggaagcattatttgaaagagaagatgttgcttattggcttgttgctaaaggtgaacgggtagttggcgtgacaaatctaacaagtattgacttgaaaacttcgagagcagaattaggctactacattattcctgatatgcttaactctggaataggccttgagtttgcatatacaaatatgctttttgctttctcttatataggctgcgattctctatttggtggaattgataaaagaaatattaatgcaatcatgttagactcatatcttggatgtcaactggattctgaagatgtagaagacataaataatatttcatacatccgttggattttatcttcggttgatttttttggcaataaagacaaccttaatgatataaggcagtttgttcgatatatgaaggcaaataaacaatattttaattattttaaaaaaaaatgcttaattcaatgaaattccatcacataggtgtagctgtcaaggacatttctgcgacagctgccgtttatgtgtcaggaggctatcatcagtcggaaataacatacgaccctgagcaaaacgtgaatatttgctggttgacaaaagaaggaatgccagtagtggaacttctggaaccagtagatgagacttcacctatcaataagactctggagaagaatggtgttactccatatcacacttgctatattgtggatgatattgagcaagctgtgaaggacttgcgaaagatgaagtatgttattgtaagcaaaccggtagaagccgtggctattcatggatacaaggtcagcttcttgtataacaagaatgtcggactcatagagcttgttgaagctcccgcgaatatttagtgtatggcaagattcgtttttagaaacaatactattgagcgcttcttcggaagtgagtatgctttctctggttatgacgatgtttccaatataccgcaggaagccgatggttatatttggtggtatcaggtgccaatcaagtttgagcagaatgtccttgcagacgagatccgaggatatgctcagaagttgaactacgtacttagtcagattgatgaaaaaaagtcgtttgtagctttcactatggatattctgtatgctgttccttttacagatgatgattatcaacttcaagcagctgtagcagaatataacaatgcgctctatgtagctgaggcaggtcacaaaaacgtgaaagtgattgacatcacagagtttacacggaagttcaatacttccgagctgtttgactggaagttttacttcattagtcagatgggtatgaatccaaaacttagtaaggatttcaaggcttggtgggacaaaaaacagaactccatcagtctgaagcgaaagaagtgtcttgtactcgacttggataataccctttggggaggcgttcttggtgaggaaggtatcgatggtatcaagatagggggagactaccctggaaaagctttcttatattggcaggaggcattacttgctctctctaagagtggtgtgatactgaccgtttgctcaaaaaacaacgagcaggatgtgctggatgcttgggataagaatcctttcaatgtgttaaagaaagagcactttgttgcctatcgcatcaactggactgataaggcgacaaatattaaagaacttgcctctgagctgaatatcggtttggatagttttgtatttgtagatgacaatcctaccgaacgtgaacttatcaagcagatgcttcctatggttgaggttcctgagtttccgacccagccttacggattgatgtctttctttaagcagttggtagaagattattttaaggtttattctgtaactgatgaagacaaaaagaagactgagcagtacaaacagaatgctgcacgtgctcaggcacaggcttcttttacagactttgactctttccttgagtcgcttgatattcagattaccattgaggctgccaatgaattcaatatacagcgtattgctcagatgacacagaagaccaatcagtttaatctgactacacaaagatatacggatgcagatgtccgtggttttgtagattctggttggaaagtttggtgtattagtgttgctgacaagttcggagataatggaatcacgggtgcaatcatggtaactccagagggtacaatcgataccttccttttgagttgtaggatcttgggcaaaggtattgagaatgctttcgtaaagaagattctttctttacttgcaaatgcaggatttgaaactatatctgccaaatatcttcctacagccaagaatgcacaggtgaaaaacttctgggagaaggttggatttacctgtacgcaagaatcggaggatggcagcaaaaactattctttggtaattaaggatgctgaaatgggagttagaaatttttatcatataacagttaaataataaaaaacatggaagaaaaagtgttagaaatcctcatggaggttcttgaagataacacaattgattcaaattgctcacaggaaaattgtgaaaaatgggattcaatggcccaactcaacttgtcagttgaactcgaagatgcatttgatgtttctttagagccagagcagatagccgaaatgaagtctgttaaggatatttgtaggattatttctgaaataaaataatatggcacatacatttatcattgctgaactatcaggaaatcacaatggtgatattgagcttgcaaagcaaactattcttgctgcaaaagaggcaggtgtaaatgctgtaaaaatccaaacttatacggcagatactataacacttgattgcgatactgaagattttcaaatacatggtggattatgggatgggtacaattattatagattgtatcaagaggcatacactccttgggaatggcataaagaattatttgagtatgcaaaagaaataggtatatgtctattttcaacaccatttgataatacggcagtcgatttactggaggagtgtggaaatcctatttacaaaatagcctcttttgagataactgacgtaaacctcattcgttatgcagcaagcaaaggtaaaccgatgataatatctacagggattgctactattgaagatttagaattggcgatagaggcatgtcattcagtaggtaataacgatattacattacttaagtgtacatctgcatatccggctcctcttgaaaaggccaatcttttgactattcctgatatgaaggagcgatttggagttaaagtcggtgttagtgatcactctcttaccaacactttaccaatagtagctgttgccttgggtgcaacagtagttgagaaacatatcatacttgatcgcgcgttaggaggtgttgattcaggcttctctatgagtactaatgagttcaagaagatggtgatagctattcgagaggtggaacaagttatgggagaagcctattaccctgaggatccatggtctttatctgcgagaaaagactcccgctccctctatattgcagaggatatgaagaccggtgatatcattaccgaattgaatgtccgctccgttcgtccggggtacggtcttcatcccaagtacctcaaagactgtttaggtaagaaagtcaatcgtgatttggagaagggtgagagaatgaaattggagtatatacaaaagtaatacaactatgactgtttttaccaagaaagaaggttaatgacaaccacacttttattgttcaacttaaaacatttaactatgaagattcttagttttcctccttcgatagagtcagtagttttctgactgcagaggtggagccgtagggttcatggttcgataccccgttgagtcatgattgacaatgtctttagcaggtagtataataagttattaaacaaatccaaagtgggaggaaatctaaccgcctaccttttttctatttttagatatttacatgcaaattatgtataaagacgtattgaaatatagcatttttggaatattgtatcactcacttcggaaggacaagcatgaataaaaatcagattgtgaatgataggaaccaaaacacggactttttttcctttctttatacttatcttatattgcataggaacaaaacagcccaagttctctttcgcaagcaaccgcatagcgtcagtctctcgacgataagtggcacgcatagcgaaccatatttcggtctctttttccacttccattatacgattatttcagaaaaggacattctcccggggctttgaacttcttacatacacctgaaattcaatcacttgcgagtactttatgtaatatacggcaagctttgtactctcttgccacggtttcttgtagttactcattacctatctggtaagaaactataaacaaacgaattatactaaaaaaacgtgtttttaaacgttcgtctatttgaacactatttttgtattcattttttcagtatcgaaacataaaagcagacagataaaaaagagatttttatccatagatatctatatagaaattaatatattaaggtagaaaggcaagagtgcaaatcttttttttaattaaacattttgctattatgaaaataccccttatctttgcgttcaaatagacgaacgttttttgaaacatctctccttaaacaaattatctcactataagccaacagcttacctccaaaaaaaaaaattaaactccacaatttatcttatatttgtaagtttactaaatttttcgttcatacctttgcaacattttatacaaataaaaatcactaaaattaaaaagattatgaactacgaaaacaaacaacaagaagaaaaaaaaagaattcaaaaaaaacaaaacggacaacaagcaaatctctgacaatagagaccttaagtcaaacagaggacgaaaaaaggagaaacccatacaagggattgttttgaaacactacgaatgcttaaagctactaatcacactctatcaagatggggcaatgggtataaaaaaggagacatcacaaattgcgttagcccgatatataaacgacaaaaaactattagggaatattcgaaacggaatattcattccattgaagctcagcactattctaaaggaaacaaacaccatctggaacgaaatgctacgagataaatccattggcataaaatagacaagaaaacacaccatgaattattatactccaacctaatcggcaaacactctaccttcgggccgacaaacaatttataaactttaaaatcattataatatgaagaagttgaaaagcccggcatcacaaagtgaagccatgaaactgagatggaaaaaacggatcgtcttcgagaaaggatacaccgagtcgtgcgccgaatggatggcagaacggcttgaagcactcctggaccatatgcaatatggacatgcgacggtagcttaccgaaaacaaaacgggagtttccaactggtaaaagcaacattgatttactacgaagcggagttccgtaagaagtatgatcccacaaaaatagaaggcgcagtagtctactggaatgtggacgaacaacgatggatgacattccaggtggagaacttcatggagtggagaccgatcgcatagggtgccaccatagattacacggattttcacggatgaattatttatactttgaggaatcaagtgaaaatgtctttggaaatccggagtaatttgtggtaaatgtattattgaaagtacaaacaactaatctaaaaaaacaaatatggcaatagcatacgacgggatcaattattttccggtgggcgtaaacttcatggaagagaacgcaatggaagtgatagaagcaaaatatggaataaaagggtcggcaattgtgctgaaactaatgtgtaagatttacaaggagggatactacatacgatgggatgaagaacaatgcctgattttcgcaaacaaagcaggaagagaggtgcaggcagaagaggtgcaggggatcatcgagattctgttcaccaaaggaatactggacagaaacagttatcagaaaaacggaatactgacttcggaaagtatacagaaagtatggatggaagcgacaaagcgaaggaaaagagagttgtcggagctcccttacctgatggtgaaaccggaaaaagaaaatggaaaagccgacactcccccggcactacaagaaattcagcaaccagagctgttcaaaaaggaaaaaacacctgttaacccgaaaaatgtagtacatcatgtagccgttgacgcaaaaaatgcatgcaattccggacaaagtaaagtaaaagaaaagaaagcagaggaaaataaagaatttcccccctcagctccccccaaaggggaggaagaagagcggaagggggattctgcttatctcccgataccgggatacgccttcaatacaatgacgcacaattactcgggactgatggacacgctaaagagattgagcattaccgacaccggggaagtaaactccatactcaggctgtcggactatgggaggaagggaacgacggtatggaaactgattgcaaacacttgctggagcgatatcggggccaaaggaagatacttgatagcggcgctaaacaaggcgaaaagaagatagcagagagtgtcagtcctctatttgtagttgacaaaaaagcaagtatacaggcttttatccagaaagggattcagtgaaacaaagaagtaaagagtgtgcttaacaaactaaaacacagtgtttttaaagcacaagatttctctcgcccaaagctttgttttaacgctacgttaaagcttgttctttaaatgcaaatagcaagtgttttcaatgcaaaaggcttgttatttgcacacaagaataaaataacggagaaatggcgttaacaatgttaattgagaaacactctacaaacaaaaagaaatctctgtcattctaaaatcaaaagtacaaatagccgtaatcaaattcccaatatattgtgaatttcatgatgaaggtacataactcaagccacaaaaagctcaaattcacaatatattgggaatttccttgcttatcaaacaaatacttagtatttttgtttcaaattcacaatatattgggaatatgaaacaaattggaatacagattcgccaacgaagaaaaatgttgggtataaatcagcaaacacttgccgatttagcacaaatcagtatcaatactataacaaaaattgaaaatggagaaataaatattaattttcaaaagctctatgccatattggaggtattaggattagaactttctctgaaaattaaaaataaggagggatatctatgagacaaggagtcgtatacttgaataaagaacgggtaggcattattacggaattatcttctaacgaatataaatttcgctatgatgacgaatatttcaatgatccatcaaagccctccataagcctgacattgacaaaacaacaacaggaatatacttcccattatctatttcctttttttgccaacatgctgtcagaagggcacaaccgcatcgttcaggcaagattattgcagattgatgaaaaagatgattttggtattttattagctacagcacataccgacacggctggggctgtaaccataaaacctctcgactatgattgaattaacttgctgtccttctactttacaaaagggattctcaacctattcgcctgttgcattgaaagagctgttcaatagccaaaaggtaaaccatatactgccatacaatggcatggacaataatgaaactaagattataccagtttctttttcttcctgtagttttcacgaaactctttgggcgaacattctttctttttcttgaagatccgattgaaattagaaagattattaaacccgcattcataacagatttcagcaatagacatagtagaatcaaccagcaggcgggcagcaaaccccaaacgaatgtcaatgatatagtccgaaagattcttaccggtacgcaatttaaagaagcgactgaaagataccggagtcattcctaccatatcagccagctgattcaggcggatctcttcctgataatgggcattaatatattcctgcactttctgcacacggcggctatccgaatgaatgccgattttagcaaaagaagaacttgacaacgtacgagcctcttcgttgaaaagtgacagttcataaagtatggtcaagaacttgatgacagcatacccccctgtttctcggatgccagcgtatcgagaaggggataaattttcaggatggcggacatcggaaaacaaagacctttctgagctttctcaagcatatcacgaatagaatcgaactgattcttattgataaaacttttgaagaaaagatcggaagagaactgaatcgttatttcacggatctctttcgaatgacaatcatgttgttcccatacatgttccagatcctttccggtaatcagaaccaaatcataatcactgatcacttctgccgaatcaccgacgatccgtcgcacaccggctgctttctccgtaaagttcagctcaaattcggcatgattgtgaatgggataagtaaactccgttttataccgttcggcaatgtagaaacaatccttatcggacagcggagtgatctcccgaataatattgctttgtagtgcattcatagctaatatagtattattagccacaaatataacacacttttttaatttcttctattccactcccgaaaatcttctcccgtaggattctggaatacgcgcaaaccaaattccggaacaatggcaagcagatgatcgaatacatcggcctgaattccttcgtaaggtacccactctttcacagcagaaaaaaagtaaagttcgaccggaataccttgttcggtgggctgaagataccgtaccatacaagtgaggttcttattgacatcgggaagacttttcaagtagttggtcagataggcacggaatactccgagattggtctggcgtcgcccattgaccaaaatagagttgtctatgtgatgttctttattatactctttcaccacctgctcggtctgctccacataatcggtcaacaattggattttcttatatttagccaacatttcgggggtacagaatcttacactgttcatatcgatattgatagaacgcttcacacgccgtccaccggactcttgcataccccgccaattctgaaaagaatcgctgaccagcagatagggagggatggtagtgatggtattgtcccaattgcgcaccttcaccgtattgagcgtcacttcaatcaccgtaccgtcggctccgtatttgggcatagcgatccagtcacctactttcagcatattatttgcagaaagttgaatgccggacacaaatcccatgatactgtctttaaacaccaacatcaggatggcagccgaagcaccaagcccggtgagcaataccatcggagatttatctatcaatacactgataacaacaattcctccaatgaaaaatagtatcacttgtgccgtttgcaacaaacctttcaatggtcgatcacgaaactgttctcgctcactgtatacatgataaacagccgacagaaatgcactgataaaacgcagaaaaaccgcaatgatataaatcatgcagatacgacggataaaatcgagggcacttacattcggaattgccaaaggaatcaacacataaataatgatgggagggacaagatgactgaggtaaatcaaaactttacggtcgaacacaatatcatcccaggttgctttggtctttttcactagtttggcaactactcttaaaagaatgttacgacaaataagatcggctaaaaaggcaatgccaataatcagtaccagtgtcataatggggcctacttcactggagtcaaatccccaggaaacgaataagtcatttattttttcggttatctgttccatataaaaactcttttatgtcttctttcaaccattgataaaggtataaatctttgtaagcactatttttgcgaagcattacctcgacattgacctgactgttttgataacaagtcagttcattatgaaattgttcgtcatgttccgccaattttttgatttcttgttcccgttcgcgtcgcagggctgtacaaacgggagtcaatactttcatcacgacattgtccatgatgtgatgcccctgaataaacagatatgttgtatcaggaagcactccaagttcttttaattcgaccgataacttatcgacctcttcgataccttgtggaaaacgcgtggataactcagaaagtttagacgttaccgaacgcctcactgcctccaaagaacgttccggatgcctcaagctgacatcgtgcaaacgaacacaggcattaaattcactcatagtaaacgtataagtatcatgacgacgataaaaccagacagaccacaggaaaagcggataagcaatctgagagtatcgtttcataaactcattgaagtcaatcaggtgtctgtcgttcaaagtggcttgcacacagacctcatgcaagctatcggcataacaatgatagttttcaatagcataagcataggtctgaaaaatatatctattacgattaattttacgtgaagtagcagtagctccttgcaacaaaaagtcataatcgctatccacacaggcaatcagacttttgcctaactcggccgtattaagggtattcatcagtaccattttcttgcctttagccaaagatgtagccgaaggaagcatcacctgaaaataatgttcttcgtcctcaaactcctcaagcagtgtacgccagaaagctacatcgtcataactctcaacataagctacaatccggcggcgcgcctttttagagtataacttatgagcagcattgaaataggaagaagtcagattgtctttgagactgattgccataggtcgtgttttagttaaatgctacttatagctggttgcaatatcacttacttcggtcacagcatcgagccatccttccataatcactgcaggagaatgtgtcgttagtataatctgcacattcggattcagttcacggatcatcgatatcagcttttgctgccattcgatatgcaaagaagcttcgggctcgtccatgaacaatacgcaatgggcattatcctgtacaagtacagtaagcagaataactaacatctgcttttcgccggaagaaagtttataaggaaacagaagttcaccatcctgatagaaagcaatatcattgcgtctacggtctatttttttacgggtatagctgaatagttcgtcaaccatgtcttgaaaacgacgtttagcaatggaaagcgtggctgctttactacgttcttcctcgttattgctgctcaacagctcgatcatcttattgcctatattgacttgataatccagataacggcgctgcaacagatagagttgccagtcgagttcggactttacattcttatctgccatacgggctgtgaaatcccccataataagcggacgatcgtaactacggataacatcataaggaatgtaagtagcttcgggattgtcgaaaaagatatgtactccgtttttttcatcactcttcacttcacccgacagttgctcgagatacccgaccgatcgattcaggatagtggtttttccaactccattgattccggatagtatattgacatccggacgaaggtcccagactatattgaaacggtcccataatccgtctatttcaattcgtttgatataattggctgatagttccataaatggttgcatttaaattaaacaaatatagaaaattcaaacgataaattggttacttttgcatcagttttcaataaaggtaacattttcggtatggagattgataagaatctgaaaggacacgcattggcatttacagccaacgtgatgtgggggctgatgtcccccatcggtaaatcggcattggcagagttctcagcgctttcggtaaccaccttccgcatggtaggtgccgcagcagctttctggatactttccgctttctgcaaacaagagcaggtaggacaccgtgacatggtgaagattttttttgcttctctgtttgcccttgttttcaatcaggggatatttatattcggattgtctctcacttctccgatagacgcatctatcgtaacaacaacttcacctatcatcaccatgattgtggcagctatctatctgaaagaaccggttaccaacaaaaaggttttgggaatctttatcggagcaatgggagcgttaatcttaattctaagcagtcaggcagtaagtgcaggaggaggaagcatttggggagatttactttgcatgattgcgcaacttagcttctccatctatctaaccgtattcaaagggttatcccaacgctattcggccatcacgattaataagtggatgtttatctatgcatccatctgttatattcctttctcataccaggatatagcaagcattaagtgggacagcatttcgacagccgccatctatcaagtactttatgtggtactatgcggaagcttcattgcttacatctgcatcatgactgcacaaaaactgatgcgccctacagtagtaagtatgtataactatgtgcaacccattgttgcttccatagcggcgatcttaatgggaatcggaagcttcggctgggaaaaaggagttgcgattgcattggtatttcttggagtctactttgtgactcaaagtaaatcgaaggcagatttggaaggtgtgtcataactcaccacagattacacagatttacacaaaatgattttaatctactgacaaccaataataattatctgtgtaatctgtggtgaatacgaattttgacacctcttcatcgttatttcagatcttcgaaataagtatcgagtaagctcttggcagcaacaaaagaggtgagatttcccttgagcacctgttgctccttttcttgcaacatcgattcaatcttggcattgtgataaaagctgtcacgtaactgttcattgatgctctcatacatccagtatttgctttgttcgttacgacgatattcaaaatagccattacctttcacaaaatcaatgtactcgtacaccatatcccatatttcctttactccaagattatagaatcccgaataagtaagtacacgcggtgtccatccggaatccggagccgggaaaagatgtaaagcattacggaattgcgcagccgccaacttggctttgtcaatgttattgccatcagctttatttatcacaataccgtcagccatctccataatccctcttttaatgccctgtagttcatctcccgtaccggccaactgaatcaataggaaaaaatcgaccattgaatgaactgccgtctcactttgtcccactcctaccgtctccacaaagatcttatcgaaccctgcagcttcacatagaataatcgtttcacgagtcttacgggccactcctcccaacgaaccggcagaggggctggggcgtataaatgatttaggatgtacagaaagctgctccatacgggttttatcacccaaaatacttcctttgctgcgttcactactcggatcaatagccaaaacagctaactttcctcctttttcaagaacgtgtaacccaaagacatcaatcgaagtacttttaccggctcccggcacaccactgatacctacacgaatcgaattaccggaataagggagacatctttcaatgacctcctgtgcggtagcctgatgttcgggacgcacactttccactaaagttacagcctgactcagaatcgtcacatcccctttgacaatgccctccacaaactcatttaccgacaactggcgtttttttacttttcgcttcagatagggatttacagatgacggttgttcaatgcctgcattcacaaccaaacctttatatgcttcgttattttcaggatgttccatggcagatattaattatgtgattcgttactcgtagcttttacatcgatctccactttcggctgtaccggatcattggtgatcatcagaattcgcaagtgtctcttcttctttccaaggttctttttcaagacagtcactctcaggcgggtactttcgcccggctgcagtatagtcttcttcaaagcaacacctaccgcaggattgaatacttgcagtttactgatctgcaaaggagacttacctgtgttagtgataacaatgtcatgtcgggctttgtttttcttaaccaaaacccggcttaaatcaatcttggattcggacagacgaatagcaggagctaaagctttatcttgctcggtcattcctgaaaagtcaggaagaagtatggctgacacggggatttcattttcctcactcactttatcaccggcaaagcgagccagataaacagaagactgagtcaaacctaaatccatcagttgtttggtatcaagtgtcagggtaatggttcctttcttacctttcaaaaggacggtaggattagtttccattttcagataaggcggaaggtgcatcaatacaggttcgtatggacgatcggaaagattgactacccccaacgtaatgaccggtttttctccgctgtgtacatcaggaaaatctatatctgtacggtcaatccggatttgtccgattgcatagggatgggttttagtaaaatccttgatctcctgaaccacctctccatcgaagttcaaataaaccaaaccaggctgcgcattgctgtaaatgccgatcgatttattgaaatgccccaacgcttttgcatcaaacgtagcactaaccgttcctttttctccgggagcaatcggagttttcgtccagttagcaaccgagcaggcacaagaggtagtaacattagtcagtaccaaaggtttatcaccagtattggtaatagtatactctacagaaaccggacgcttccattcaatctgtccgaaatgatgggtctccttattagaagagatacgaggttgagctacagccgataaagtaatagtaagtaaagtaaatatgaagagtaaactacgtttcattcgttcctattttattattgttagttgtttaaagtacaaaaataggagttttcgtcgagaatctgccactgattacatatttttaagcacaggacatagtggctttactcaaaaaaacaggggctgcgtcaaaactcaccacagaggacacagagtaacacagagacaattttaggttgttgattatcaataaaaagactctgtgatactctgtgttactccgtggtgaaaaaaatttcgacacaccctcctgaaaatatttaattttatttattgagatacgttacagcgaaacgaagctgagtgggctgcatattcgggtgcatatgcactctgaatagtagcaattcctgtttcgtaacttcctgcacgatcgacacggtaactatactctaaaacataagttcctttattcaaggtatcgaaaaagaaatcagttgaagcatcttttactgctacataacaaccgacatcaccaacattgcgatatccggacaggacttcaatcggttcgagacaggcagcccgctggtctttcaactgtataaaatccatcgtacggtcaagacggacagtcagacggactaccactttatcaccaacctttaactgagtcttaccaataatcggttgcaactgacgattgtcatgagcaatcgtttccacatataatttcttatctacatccagaccgctcccttggcgaactactttatcaagactctcttcgaactgtgcatatactgctccccaggcaatacccggatctcgtttttcaacaataatctcagcggcatctacggtctttctgtccgtaaaagtctttttgatataacctaaccccggaacagtcgtcttagcaggacttatcgtttccaacacttcattgccaagaacaatacgaacatctccttgattatccagtaaattagttccattgtaaagcagagcataaacagcatctgcagtagctaccggagaatcccattgctgggtctgtttctgctttaaaagccacattttcatttcttcaacaacctgtgcatcctctcccactcgttcaaaagcttccattacatccacatgggcaggtactttcaggttattccaagtatatggactgtcggctgtatcaaaaaacataccctggtcatctgtccgagtgagatattctttaagggatgccataaactcctgagcctctttcaccttgcctactttctgcaagataatggccgaccaagctttttcggttacagactgctgagacaatgacggagctactctcgaaaggaaataggtatatgcttctttcatggatgccggcactttttcgtcagaaatagcaattagatagagatactttaatgcacttcgtgaaattccttgtgatttactgccgtttttttcggcttcacgaatagaacgatattcctgtaaggcctctttatgaagatagttgaaagccgaccgttgcatattcaaggctgcaccttccaatggttttcctgtaagcagggctatacgtgcattctgctccacaataaaatcggtaacaaaaagactaccgttcatacctttataccaactccacgaaccatcaggtaattggagttcctgtagtttcagtaaggctgctgcattattattacggatattattcaaatcgaatagagtggcaatgcgttctttttgttcgctttccgaggtagcttccatcacccagggagattcggaaagaaggatattcttcacttcctgattcttttgcaaattactcaagaaagtctctttggtgcctcccccgagtttccaactgtcaaaaatagctcgaatacgtggttgggcattcattatgtaagaggccattgtgttggcataccaggaagtagcccatgaaatggcatcatcatttctgggttgcgacaacgctggcaatgcttgtacggcataccaagccggattggcagtaaactcaacggttaaacgccggttggttgcagtcttgctatgatgattgaaaaggtctgctaaagagaaagtacgcgtttgttcaccacggacaggcataggcaaggtctctgtcagattctctttattgctgagaaccggaagcaggtgttgttcaccatcgctgaaattgcctccttcggctatcatccggcatcccagaacttcatatttatcagtaaccgtaaacaggaaatccaccccgacagtctgtccgggcccggcattaaatttcttttgctgggtagatatcacctgatccgtcataggattgaaaagcacaagtttcactgtacccgacatgcttttacctgtgagattgctgacagaagcagcgatggaagtatggtctcccacccggacaaaccgcggcagatttggggtaagcataaactctttactggtaacagcagtagcatttatctgacccgtcatcatattctgtgtgtgggcataaccacggaaattccaggtcgtaaggctttgcggcatacggaaagagaagctgacctctccctcagcattggtatgaagttgcggatagaaaaaagctgtttcagcaaagttggtacgtaactctatatctgcagccccattcacagccggatgatctgcctgatttacagcccccgcatcttgtgaaacagaaatcaactcggattcaaaaaggacatcgtctgcggcctcgcttttcatttgttgtttcatagctcccattgcacgcatacgagcatagcgggtaaccggagcggcgtcattggttatcgacaacacctcggcaacagcatatccgacaggaggtaatacaaaatgatcgtaactgaacgaaggtactttcaaactacgctgacggaaaccaaaatagaaatagttcgaatctgcatagtccctcctccaatgggaaacaggaacggaaagatgataatataactgcagagactggtcagctttccagattttatccagtgaagcatcgtacatggtagccaacatctcggccaaaaccggtgatccttgtggattccggatcgtcagcttccattcctcttcctgtccgggacgtaatttgtcacggaatacatcccagcgtatattcaaagtataatcgggcaaacgctttgtaagacttacttcctgttcgtaaactattcctttacgaacaaatgcaaaagtaatgcccaaaccatttccataagcctcccgataagaatactcaaaacggacaagcgaatcggacaaatgaagaagtttgctctccagatgcttgttaccactgaatacatccataagtacataagcatccttttcggaagttccaaagtagaatagtgcaggatgttctgcatcaaaccgggtatttacctcataataccataaaggcatggacaccggtggacgtttatcattcaaagcgaaaaggatcacaaccttttccgtttctgatttacgtccctgggcatctgtcacagaagctacaagtttataagcaccggaaggtagtgttttccagtcggacaataacgtctcttcattggacctgaacgaacctgaaaggattgcctgagcagaaaccttctgatctttcacagctttggattcctcataacctgaaatagagaacaattggtaactgccttcgacggcaaccggtttacgttccagattatttacctgaaaagtagcttttatggaatcgtctttacagataagtccgtttatatcggcaaatagcagcaaggaagtctttccggcccgcaggctgatttccgaagtctgcgtttcgcccgcaacattcgtgaccgagacctgtactttatagtcataataggaagaagtgtcatcaccatcgtcaaggtcggagcctgaagtatcgggtttcaggtcaacagggagctcaaaatttccatctgcccccagacgcacggtgtcagaagccaatatgacgggattcactccccacatccgccaggaacaaagggagcgggttatggtataagtaaccggaatatcctgtaaaggcacaccgctgaaagtcttgacattccctttcaattcgacacggtctcctaaacgataactttcagtcaccggctcaaatgtaatgtcaaatgtaggacgtttataatcttccaccctaatggtacggaaaccgttttgagtattcaggctgaaaatgccgttcaaacaaacggatggtaatacgaattcagcagtaaaagaaccgaaatcaccggtacgcaacttctttgtacccacttcctgcccattggcatccgtaagtgtcaatgtatattctctcccggcaagcacatgggcagaatccgggtattgttcataggcaattcctttcacatatacagtttgtcccggacggtaaagagaacgatcggtaagcaaagttacggcagaaaccggctttgtatcatctgtaaagttataattcccaccccataaatagatttgaggcatagccgtatcggctcctttggcagccgtcaggtatctgtactctcctgatgaagcaaactgtgctttcccgtcagcattagtggtagcggtcagaagctgtttgttctgtcggtcgaaaactgaaagcaggaccccctctataggcttcccactcatatcatcgagtacagctacctcacttagcttggaaggcaaagagcgggtcagcactttgaagcgggtggaagacagaaacttcgcagaattagaacgaacctcagcatccggaacaatacgaagggcatagaggcctgtttcaggagctttcatatgaaatatagagtcttgcattttatagtcaccagacgggaaaaggacataatgcaccgacgaaagcaagcgcccatatttcttcaagaatgtttcatcaggtacttccaccgcattggggcgagccggcaaattgatcgcatacaactgaactgcaaaactcttcagattcttaaaactgactttcaagtcgaattcctcaccgggataaaccgctgacggggtctgcactgtaaaatccgggctcaggatatcctgcttcagctctttcaaggcattaatacggtgataagccggatagcgggaaatagcctcatcacacaattgcaatccggaagcaggtacgccggcattcaccgcctcctgggccttaagtaaataaacctcggcacaaatgtcatgtgactggttctcggcaatcagtttattcaatgctgccagataaggatcttgcgtcagcccgattctaccttcgggagcatgataaggacgaaaaccgggatcggtgcgccttttccactgcagataatccaagttagtaagtaacagagcgtccggattatcggtccggcgatatgaatccatcatgtgtcgataaatcccttcgatacgtgcatttatcagagaatcactgcccaacccggataaactctctaatgaagcaatggcacgggaagctaagagatgatacatatcatgatgataataatcacttgttacccccagctcgacaaaaggaatgtaacttcgggatgaagtatcgagcagtaacagggaatcctgaaacgttacggctgtttctgacatcactttcgttacaaactgatttttactccactcccggatatcatttgagggagtcacttcctccaaatctgtacggcggtttagtttccaacgattttgagaagtataatcggcatacatactgccgataagcgaatgcagaaccgcgcggtccagtggcttatctgtagttttcacccactgctctaatccgttcaacgacacatagaaactatccggagtgatctcttccctgaatctcatctgccagacataggctttcagcatttgaggagagttcttctcaatttcagctttcttataaatttcaccggtcaaccggacgatagtctcgggcaagcttttctgttgggcctgctccacttgcttccataacttatcgtatgattgggcatgtgtccatgacatcattcccatagaaagtaacacgataatacaaattagtctaatcttcatatcttaaaagtttaagtatcaatacataattaacaaagtaacaaaataaagtttaaagatttgttctttttcttataaaaaaagagaacagatcgggcatatttccataaccagcatgagcaaaattaaggtcttttaacgcaaaactgaaaacgacaagactttttcagttaactttgtaatcgcaaccattaatctaatcacaaaccaacacacaacatcttatgaaaaacagacattacttgaagtatatgctggcgattaccgcattattattcaatggagaagcaatctactcacaaacccatccgatagaaagttatctgaaagcggcaggagaccatgcaaccatttataatggtgaaatagaatttacgtacagtcttgctcaatacgaaaatctcccttattttcaaagtgacgaatttacttccggagagatcatcttcagaggtaaccggtatccgggtctggcccttcacctggatttatacaaagaccaactttcggctctgaatcccggtagccgtcatagcattattattaataacgaaggaatcgaacaggtaaaactacacaatgctacattcatctacttccgtccaacgccaaatacaaatctggacaaaggattttacgaattactgcacaatggaaaagaattgagactattggcacgcaaaaaatattatattgctcatatcagtgcggaaaaaataataaaaaccggcaaacaccagactgaatatttcacgtacaaagcaaaatattatctggagtacaacggagtatattattccgtcagtaacaaaaagacgtttgccaggatctttccggaacagcgtaaactgataaaccgctatgtacgaaaacagaagctaaacttccgtcatgatactgacgcctcactgacagcccttacaaactattgtgaagaattgatagcccccaaacagacacgatgaaaaagaatatatacctatggatgctgcccctgttattctggtggccgcaacaagcagtggcacaacagccgctctcacttcctgccgacagtataaccattgataccctactggaatcaatggagaaaaatacatcctacagaatttatactaccattgacacctccttcaaggtattggtaagaggaaagactacgcctttacagcagttgaaagaagcactggcaccgacaccctataaactatcggtatatgggaacattttattcgtgctgaaagaacaggagcttatcacactattgcctcccacactgacaggcgaaccggaaaaagatgaaggttactatggggatgtatatacttatctgagagacgaaccggaaaaagcatcttcagaaaacaaagtatataatgtaggagatgtacggatcaaacaacgcccccggaaagcgacactcaaagggcaagtgactaactttaaaaccggtgagcccatgatcggtatcaatctgattttaaaggacccatggatagcgacaacaacagacgcaaagggtaactttacccttgagcttcctaccggacataagcaattggacataaaaggactgaatgtaaaagatacgcgacgtcaaatcatgcttttcagtgacggaacactcgatatagaactggaagagagtacacatatgctggacgaagtaaccattacttccggacgcatacagaatgtaaagagcacacagctgggagctgagactttgcgccctacacagctgaaaaatatcccaatggctttgggggaagtggacattctgaagatggtacaagccttgccgggagtaaaaacagtaggtgaagcttcaagcggattcaacgtacgtggcggagctaccgaccaaaacctgattttacttaatgacggaaccatttataaccccaaccacttatttggcttcttcgccgctttcaattcggacatggtgaaagaggccgaaatatataaaagcagcatccccgcacaatatggcggacgtatctcgtctattctggatatcaccggcaaagaggccaataaagaaaagttcacaggttcggcgggtatcggactggtgacaagcaaactgaatctggagattccggtcatcaaagacaggacatctgtcttactaagcggacgtactacatattccgactggattatgaaacaacttccggaaaaaagcggttacaaagacggcaccgccggtttttatgacctgggcgccattgtggcacataagttcaacgataaacacagccttaatatttacggatattatagccatgaccgctttgctttcaactcaaacgaaaaatacggttacaacaaccttaatgcctcagcacgatggagggctgtatttaatgagagactggtgggatatttctcggccggatacgatcactacgactacaataaccgggaaacagtcaatgcctcaagcgcatataagctatcgtttgacattaatcaatatttcgttaaggcagactttacaaacaaactgaccggcaataatacattaaactttggttttaaatcaatgctgtacaatatcaattcgggaacttacgaacctgaaggaagtgaatcactggtgaaaaaggatgctttgcaaaaagataaagctctggaaacggcgttctatttgggtgatgaatgggaaatcactccaaaactgtctgtcaacgcaggaatccgctattcgctattcaatgcgttaggcccacgttcgtattataaatatgaaccgggtacgctcccgcacgaatcgactataacagatactatcattgccggagcaggaaaagtgatgaaaacctatcacggacccgaattccggctatccgcacgatactccttcacggatgatttttcaattaaagcaggatttaactcgatgcggcaatatatacataaactgtcgaatactgtcatcatgtcgccaaccgacacatggaaactgagtgatgtcaacattaaaccccaaaaaggttggcaagccgcggcaggactttacctgaattctccgaacggtatctgggaatactcagtggaaggttattataagcggatgtccgattatctggactatcgcggaggagccaaactgctaatgaaccaccatattgaaactgatgttatcaacacgcaaggacacgcctacggtgtggaactgcaggtaaaaaaacaggttggaaaactgaacggttggatgaattatacctattcgcgtactttcttgagacagaatgacaaacggatcgaaaaaccggtaaacaacggtgactggtatcctacggaatatgataagcctcatgatttcaagtttgtaggtaactataaatttacgcaccgctacagtatgtcgatcaatgtggactacagcacaggacgtccgacaaccattcctgccggacaatattatgatgagtcgacacaatcgatgcgggcttattacacggaacgaaactcataccgtataccggactactttcgtacagacatctctttcaatatagagcccagccatcacctgacgctactaacgcatagttctatttctatcggaatatacaacgtcaccggaagaaaaaatgtttattccatttattatgtgtcggaagaaggtcagataaaggggtaccagatgtctatcttcggagtgccgattcctttcattacatataacataaaattctaacaccatgttgaaatcaaaatatattatctatctattgctactctgcctgacaggttgtgtctccgaatttaacgcacaacttcccacttccgacgaagaactgttggtagtgaccggcgacatcattgccaatacggaagtcgtattttcattaagtaaaagtgtcccactgtccgaagaatccccggaaaactatcgagacattgaggccaaaatcattgtaaccggcagtgacggctatcggagtaatcccggtaaggctatcggagaaggcaaatatcaaatcagcatcggggaattacagaacaacgtatcttatggagtagaaatagaatataatggagagatttatatctcttctccctccgaaccgatggaaactcctgaaatagacagtgtttcatggatacagcccgtaaaagaacagccactgaccatccgggtatctacacatggtgatcccggaaaaacccaatattacatgtggaattacaaagaagactgggagattagagctaattacatgacaacttgttacttcgatccggaaacaaaccgcatttacgaggacagcagttaccctaccttctattgctggaaaaaagaattatccagaaatatattgatcagttcaacccaatcactgaaagagaaccggatcataaacaataagctgtttgaagcaccggtaaaaggagatagatttacagtgttatacagtgtactggtacaacaacggacactgagtaaagcagggtatgaatattatctgaatgtacaacagcaaaatgaagacatgggaggaatctttactccacaaccttccgaagttcagggaaatctcagttgtaccactcagcctgagcgaagagccatcggctatgtcagggtttacaaaaacatagtcgaaaagagaatctatattcgccccaatgacatagaacgtcctccccgatacacagattgcgaggaactgacggacgatgatctgaacgaaatgggctacaacacctatctgacaaggtatctggctggctatcgtcctgtcggaacaggtacacacatcgataactggacgctgcaaagatgcacagaatgtgaatataacggaggaaacaaaaacaaaccttcgttctggcccaatgatcaccaataacttaaaaagaaaggagacaatcatgaaacgaatcttcacactatatttctttgcattgttttgtctgatttcacaggcacaggaagaactatacgaacgggtgtatgtacatacggacaaaacgtgttatctggccggcgaagaagtttggatcaagttttataccactgacacccacttccaaccatcttttttcagcaaagtgggatacgtagaaatatcaaatgccgaacgcccgcaggcccagttaaaattagcacttgacaatggtagcggttcgggaaaaataaagattccggctgatgctccctcaggtatttacgagttaagcggatatacccaatatatgagaaatgaaggggaaaaaatcttttttcgaaagcagattgccataatcaacactttccggattgcggaatctgacccgataacattagccgattctacggaaacatacccgaaagaagtaccggctatgaacggaaacattcgtataaacacttcccggccgtcgtatagtatgcgccaacctgtagaattgaccatcaatggcctgcccgaagaagtatccgaccttatcgtttcggtaagccgtaatgattcactggtcatacttccacatcacgaagaatctgtctggagacagcaagttaccagtacgcccggcacattctccggtcaatggataccggaatatgaaggacatatcatccgcggacaaatacaaactcccgaaggagaaacactgaaacagatacagaataaacatgtgtcagcagacatcgcttttgtaggtaaagatatccggtatgtacaaggacaagtagacgttgaagggaatgcacgattctacacaagcaatatatttggaatcaatgacatagtggctgccgcatggggagctaatggagaatcttaccaaatgaatattttatcgcctttctgtgagaatctgccgaaaaatctcccccaacttaaactctatcgaaataaaaaacgattattggaaagaagcataggcatacagctacaacaagttgtcatgctcgattctcttgaccatggtatccctctgcaatcttgttacgggctccaaccttatctgaactacaatctggatgaatacacaagattcagcacgatgacagaaacctttgtagaatttgtacgtagcgtgataatacgcaaagtgaatggtaaacgcaggctaaaagtactcaaagagggagaaaaaagattcaatgtcggaaatacattagtgttattggatggtgttcctattcacgatcacgaagatattctgaagtataaccccaaattggtgaaaaaaatcgatatctataacagccgctatgcttttagcggtgaaacattcgaatgtatgatttccctgaccacgcaaaaaggaaacctgccttccatacagttaagtgacgactcgcaactgacagtatatgaatgtcctcaattgcccgttgcattcagcatgcccgagtacaaaaacgaagttgacagaaaatcacgcaaaccggatttccggcatacattatactggaacccctccgtaaaaacagaaaagggaaaagctaccacactccttttttacacatccgaccttgaaggagaatttaaagtagtggtggaaggctttacgcaccaaggagaagcaatccgaggtgaaacgagttttcgtgtaggagaatgaccctcgcagtccaatgggtgaagtaactccccaataaaaaaagtggggaacacttttatttagtgtatccccacttcatcatttcatttctgccggcttctcttaaacatctttccagcagatgcattactacttttttcattgcttcaaatactaataataattaccttaattaataaacacacatcgaaaacctaaaggagagaacgcttaaagcgttacatatccccagatgttaggattggcatttgccaaattctttaataaacttcttacaatcttcataatctttttacctaaaaaaactgttacctaaaaactatgttatcctaattcttatgttttacagcacaaaaataaggcctaaatagatacgttgtactcaaaaagggaagaaaatatgttttaaaacatatttcttgatatatatcaagaaaatcggtttctattggcaatcatatgacaaaaccggacataaataaagtcagaaaggcaggttgccattgacaattctgcatttggatgacaagtcggcatgaaacaggaaaacaaaaagagatccttaaaaaagaagagaggcaaacgcttgtaacgcttgcccctcattcgtatattcgctgatgaacctttatttaatcggtgtctgttctaatgtagcaaccagaaaatcatagaatttctgcacagtcggaatcaaggctctttcatcaggagagtgcggtgaacgcagtgtagggccaaatgaaatcatatccagtccaggaataatagccccaatgataccgcattccaacccggcatgaataactttcacttccggctctgtaccaaactgctttttataagattctttcattgcatgcagaatcggagaatcgatgtcgggttgccatccggaatatcctcccgtcatctccactttcatacccgccatagaaaagcaacattcaaggctggtagtcagacattctttcatgctgtcgctggaactacgtgccagaatcttgaaagaagcttttccaccaccaatattaatgattgccagatttgaagaggtttctactgtatcgggaattgtaggaatcattcgcatcacaccattctgacaagcaaaaatagcatcgatcagattatcctgaatctcttcaggtacttctcctgcaggcagttctacccgctcggcagtgaagctgataggagtttcgattgctttatactcttcattgaaaatatcttcgcaatacttcactaaacccaatagttcttcttcattttcagcggggatagttactactgcatgggcttcacggggaatggcattccgcatatttccaccttcccaagttgccaggcgagcttcataacttgctacagcttcacgcacaaaacgtaccagtaatttgttggcattggcacgtccctgattgatttccagtccggaatgaccgccacgaagacctttcaaacttaccttaatggcaatatcaccaccttccggagccacttccttatactcaagaaatgcggtaacgtccataccaccggcacagccgatgtaaagttcaccttcgtcttcagaatcgagattaagcagtatttctccattcacagtacccggtttcagaccaaaagcaccaaacatacctgtttcttcatcctttgtaatcaaagcttccaacggtccgtgtttcagattctgatcttcaagaacagccatgatagcagctactcccaaaccattatcggctccaagtgtagtacctttagctttcacccattcaccatctatataagtttcaatcggatctttctcaaaatcgtgaacagtatcattgtttttctgtggtaccatatccatatgtgcctgaaggattactccttttctattttccatccccggagtggcaggtttacggataatcacattgccggcttcatctacaaaggtttccaagccgagacctttaccgaaatttaccagaaacccggtaattttttccatatgtcccgacggacgcggaatctgcgtcaaagaatagaagtgcttccatacattttgtggagctaaatcaagaattgtgctcataaatgaattatttataggttttaaatcaatttctaaaggtcaaagctactaaaaagaatggaaaagaaagaattaccggaagaaattcaaataaaaaaagttcaaaaaccggatttacagattaaatatgtatagcaataacacacatattgttttaagttagcaaagcgcatttcctgaaacacaattgttatcagcaaatattattttcgtcggaggaaggaaatagccgccaacccgtaaatgcctaataaaacgaccaataaggtttgaatgccatgaacgatcaatgcaaatattccggcatctgtcgcatttaccccataaagcatcatcatggtgatcactgcaaaatgccacggaccggccccattcggagtaggaacaattacggcaaatgttcctccgacaaacatgaccaatgcagcaagaagtcccagatgtgccgtaaaagcaaaacaatagaaagtgaaataaaaatggagaaaatagctgagccaaatcaaaaagctataaagcaggaaaagcggaagatttttcacattccgcagtgacataatgccttcacaaacattcagtacaactcctttcactttctcgaaaaaagaaagggtacgaatcaaataataaaatagcacaacaactcctattccacaaaacagaatgatatagaaccaaacagacgtaagtaaatgcatcaatgaaggaatcttcgtaccggtttgttcaagaaaggtgacaaatacaggcatttgcaacaaaaccgtgacaccggtaatcaaaagaatagtcagtgtatctaccaaacgttcggttaccacagtacctaaagatttagcaaaggaaacatcatcgtattttgcaagtatcccacaccggctcacttctcctacccgcggcaccaccaaactggctgcatacgaaatgaaaatggcattgacgcaatcacttcttcggggaaacgctcccaaaggttccagcgtctgacgccaacgccaaccacgaaacacttgtgccgatatgccgaaaagaagtgaaaaagccatccaccaccagtttgtgccgtgttgcaaaacctccgcggcttttacaaaatcgaagtcacgatagacccaatataagataaagcctcccaaaaccaatggtaagataagtttcagtgtcttttttattagtttcttcatccctaattctttattcttcatttaaaagaattacctttgtctgctgcaaaagtagttatttagttgataaatgaaattagtaaagcctaaaaagtttctcggacaacacttcctgaaagacctgaaagtggcacaggacattgccaatacagtagatacattccccgaactgccgattctggaagttgggccgggaatgggtgtgctcactcagttccttgtcaaaaaagaacggttggtaaaagtggtggaggtcgattatgaatcggtagcctatctgcgagaagcctatccgtcactggaagacaacatcatcgaggatgacttcctgaaaatgaacctgcaacgtttatttggcggacatccgttcgcattaaccggaaactatccttataatatatccagccagatatttttcaaaatgttggataacaaagacctgattccttgctgtacaggaatgatccaaaaggaagtagccgaacgcattgcggccgggccgggcagtaaaacatatggcattctcagcgttctgatacaagcctggtatcgggtagagtatcttttcactgtaagcgaacatgtgttcaacccacctccaaaagtgaagagtgcagtcatacgaatgacacgtaacgaggtacaagaccttggttgtgatccgaagctattcaaacaggtagtgaaaactactttcaaccagcgtcgaaagacattacgaaactccatcaaaccgatcttgggtaaagattgcccgttgacagaagacgctctattcaacaaacgccctgaacaactctcggtacaggagtttatagacctgacaaaccgggtggaacaagcgctgaagtccccgatagaagcaacttctcaaaaagaaattcccaatggggaagccggattatcggactgaacaaacgtagtatactaaacgtgacttcctcgatttacgggaagcaggtaaggatgtaattatgaacgaagaatacattgacaacgtaaaagagcttatcggagaaaaagatgccgataaagtaaaagagcttcttatcgatctgcaccctgctgatatagcggagttgtgtaacgaattgaatccggaagaagcccgcttcgtctatcgattacttgataatgaaactgccgcggacgtacttgtagaaatggacgaggatgttcgtaaagagtttcttgacatcctgccatcagaaaccattgccaaacgtttcgttgactatatggatacggacgatgccgtagatttgatgcgcgaactggatgaagacaagcaggaagaggtactttcgcacattgaagacatcgaacaggcaggagacattgtcgacctgctgaaatatgacgaaaataccgccggtggtttgatgggtacggaaatggtgaccgtcaacgaaaactggagtatgcccgaatgcctgaaagaaatgcgtcaacaggcagaagaacttgatgacatctattatgtatacgtgatagacgatgacgaacgtcttcgcggaatatttccactgaaaaagatgattacgtcaccctctgtatccaaagtaaaacatgtgatgcagaaagaccctatctcggtgcacgtagacacacctatcgatgaagtggcacaaattatcgaaaagtatgacttggttgctatcccggttctcgacagcatcggccggttagtaggacagattaccgtcgacgacgtcatggacgaggttcgtgaacaatcggagcgcgactaccaattggcatccggtctctcgcaggatgtagaaacggacgacaatgtacttcgtcagactacagcccgcttgccctggctattaatcggtatgattggcggcataggtaactctatgatattaggtaattttgattctactttcgccgcacatcccgaaatggctctttacataccgttaattggcggtacaggtggaaatgtgggaacccagtcatcggcacttgtcgtacaaggcttggcaaacagttctctcgatgctaaaaacacgttcaagcaagtcagcaaagaagctgtagttgcattgattaatgccacaatcatctctttactggtatatacctataatttcattcgtttcggtgcaacggccactgttacttattcggtatccatcagcctgttttcagtagtgatgtttgcctccatcttcggtactctggttccaatgacactggaaaagatgaaaatagatcctgctatagctacagggccgtttattgccattacaaatgacatcattggtatgatgatgtacatgggaattacggtgttattatcgtaaaaaacagctataatgaaaaaaaataaaggaaaatagtatgaagtaatcattttatttcattaatttgtgacctaatggatttaaggacaaatcctgttttcctaaaaacgaatatacaatgatggactctcatgacactaaccaacctttgaaacaaggggaattagaagaagaaaaaaaagcagttgaggtttctgaagagattacagaaactccggctgaagaaacgattgctgaaaaatcaaccgaatcaggttcaagactgaacactaaagaagaagtgctgtcccgattaaaagaagttgcccaagatgctgaaaatgcaagtaaacaggagctggatggtttaaagcagactttctataaaattcataatgccgaactcgaggctgcgaaaaagttattcgtagaaaatggtggtgccgaagatgaatttattgcacagcctaacggtgtagaagaagaattcaaaagtttaatggcagccatcaaagagaagagaagtgctttggctgctgagattgaaaaacagaaagaagagaatcttcaggtcaagctgtcgattatcgaagaattaaaagaactggtggaatcacccgatgacgccaataaatcctacaatgaatttaaaaagctacagcaacagtggaatgaagtaaagctggtaccacaggctaaagtaaacgagttgtggaagaattatcaactgtatgttgagaagttctacgatatactaaaactgaataatgaattcagggaatatgatttcaagaagaatctggaaatcaagacacacctttgtgaagctgcagagaaactggccgacgaacaagatgtagtctccgctttccatcaattacagaaactacatcaagagttccgcgataccggcccggttgccaaagaattgcgtgacgaaatatggaaccgcttcaaaactgcctctactgctgtcaatcgtcgtcatcagcaacatttcgaagcattaaaagagagcgaacagcataatctggatcagaaaacagttatttgcgaaatagtagaagcaatcgaattcgatcaactgaaaacatttgctgcatgggaaaccaagacgcaagaagtaatcgccctgcaaaacaaatggaaaacaatcggtttcgctccacagaaaatgaacgtgaaaatctttgagcgtttccgtaaagcttgcgacgagttcttcaagaaaaaaggagaattcttcaagtctctgaaagagggtatgaatgccaatctggaaaagaaaaaagcattatgtgaaaaggcagaagctctgaaagatagtaccgactggaaagaaacagccgaagtcttgactaaactacaaaaagaatggaagacaatcggccctgtttctaaaaaatattcggatgcagtttggaaacgttttatcactgcatgtgattacttctttgaacaaaagggcaaagccacctcttcccaacgttctgtagaacaagaaaatctggaaaagaaaaaagcaatcatagcccagttaacctcaattgacgaaacaacagatgctgatgaagcaagcaaagaagttcgtgaattgatgaaagaatggaataatatcgggcatgttcctttcaaagagaaagataagctttataagcaatatcacggtttgattgaccagcttttcgaccgattcaatatcagtgcatcgaacaagaaactgagtaatttcaaatcttctatcggtaatattcaaagtggaggttcgcaatctatttatcgtgaacgcgaaaaattggttcgtacgtacgagaacatgaaaaacgaactccagacctatgaaaacaacttgggcttcctcactacctcttccaaaaagggaaacagccttttgaccgaaattaaccgtaaggtagaaaagctcaaagctgatctggaattggtattgcagaagataaaggtaattgatgaatcaatcaaagaagaataaaggaaaataatttttagttctatgtaaagcgaatcagaaggcataagcccctttgattcgctttttttatatacgaaaattataaataggaaagaataccaacaaagagagcgaagttttatataaaaacttcgctctctttgttgggctatctggactcgaaccagaaatgacaggaccagaatctgtagtgttaccattacaccatagcccaatgtcgcttaacgattcacatcctttgtttctcgtttgcggttgcaaaggtacaaagttttttttaatcacaaatacttttcgctctttttttgcaaaaaaatatctaatacgccggattccaaagagatgcatccctaaaaaaaaacaaaaaatgaaatagatttagcatataactttccttgatacaataaatcagcgtatatttgtaaaaaatatcacgtttatgacaggaaaacaaagaatgccccttccttgttataaacagaaactaaacattgattatttaatttcaacctataaatgaacgaaacgaaagtattaatagaaaagataaccgaaggtatacaagaaaaaaaaggtaaaaacattgtcatagcagatctgacaaacattgacgacacgatatgccaatactttgtaatctgtcaggggaactcccccagccaggtcgttgccatcgtagattccataaaagaatttacccgaaaaggtgccggcactaagccctctgccatcgatggacaacgaaacgcagagtgggtagctatggacttttctgacgtattagtacacgtattcctgccggaggccagaaacttttataatttggagcacctgtgggcagatgccaaactaatcactattcccgacattgattaatctatcagtatggacaataacagcaagaaaaccaacaataaagtaaatatgcccaagttcaatctgaactggatgtatatgattatcgccctgatgcttttagggctgtatttcgctaacggaaacagttctgttaacaagaacatctcttatgatgaattccaacaatacgtacgtgacgggtatgtcagtaaagtgattggctatgatgacaacacagttgaaatttatattaagccacagtatgtaggagctgtattcaaacaagattctacacgtgtaggccggaatccgatgattaccaccgaagctccttcacgcgaaaatctggataacttcctgcaaaaggagaaagaagaaacacatttcgacggttctgtcagctatgataagaagaaagactacttcagcgcaatactttggaatgtgctgcctattgtctttctgattgccttgtggatattcttcatgcgccgcatgggcagtggtgccagtggtggagcaggtggcgtattcaatgtaggaaaatcgaaagcacagctctttgagaaaggtggatccatcaaagtgacatttaaagatgtagccggcctggcagaagccaaacaggaagtagaagagattgtcgaattcctgaaagaaccccagaaatatacggatttgggaggtaaaattcctaaaggcgccttgctggtaggccctccgggaacaggtaaaacattgcttgcaaaggctgtagccggtgaagccaatgtaccttttttctctttggccggttccgatttcgttgaaatgtttgtcggtgtaggtgcatcccgcgtacgcgaccttttcaaacaggctaaggaaaaggctccttgtattgttttcatcgatgagattgatgccgtaggacgtgcccgcggcaagaatcctgcgatgggcggcaatgatgaacgtgagaacacgttgaaccagctgctaactgaaatggacggtttcggctcaaacagcggtgttattattctggcagccactaaccgtgtggatgtactcgataaagcattactccgtgccggacgattcgaccggcaaattcatgtagatttaccggatctcaacgaacgtaaggaagtatttggtgtgcatttgcgccccatcaagatagacgatacagtagatgtagatctgctcgcccgccagacccccggattttcgggagctgatattgcaaacgtatgcaatgaagcagccctgatagctgcacgacatggaaagaaattcgtaggcaaacaggattttctggatgctgtagaccgtatcatcggtggacttgaaaagaaaaccaaaatcaccacggaagccgaacgccgctctattgctttgcatgaagccggacacgcaagcatctcttggttattggaatatgccaacccattgattaaggtaaccatcgttcctcgtggacgcgcattgggagctgcatggtatctgccggaagaaaggcaaattaccaccaaagagcaaatgctcgatgagatgtgtgccactctgggcggacgcgcagcagaagatctcttcattggccgcgtatccagtggagctgccaatgaccttgaacgtgtgaccaaacaggcttatggcatgatcgcctacttgggaatgagtgaaaagttgccgaacttatgctattataataatgatgagtattcgttccaacgtccgtatagcgaaaagactgccgaactgattgacgaagaggtgaaaagaatggttaacgaacaatatgaacgtgccaaacaaatcctctcggaacacaaagagcagcacaacgaattggcgcagctactgatcgataaagaagtaatctttgccgaagacgtagaacgaatcttcggtaaacgtccttgggcttcccgttcggaagagatcatggcagccaatagcaaacaagaaaataccgcccactctacggatggagaagataccgatactccacaagcaacagagtctcaagaagacaatgcgcaacaagaaccggcggcatcacaaaactaaaaatgtaacagcaccttgaaaaacaactttttacaacgcgccataacaggaatattatttgtagccatcatagtgggttgtatactgtacgatccactggctttcggaacacttttcgttattgtcagtgctttgaccatacgtgagttcggtcatcttgtcaatcaatcgggggaagtagccatcaaccggaccatcaccatgctgggaggagcttatctgttccttgctctcatgggattctgcattgatgctgccgattccaaaatattcattccttatctggtattgctcatttacctgatggtaagcgaattataccttaagaaaaagaatccggtactcaactgggcttattccatgttgagccagatgtatatcgctctcccttttgctttactgaatgtactcgctttccagaatgatccggaaacaaccagcgtctcttataatccgatattaccgctttctatatttgtatttctatggctgaatgatacgggcgcctactgcttcggctctctgtttggcaagcatcgtttattcgaacgtatttctccgaagaagtcatgggaaggttctatcggcggcggtatcgtagccattgccgcttcgtttgcatttgcctatttctttccggtcatgacttgggctgagtgggccgggttggcactggtcgttgttattttcggaacttggggagacttaacggagtcacttctgaaacgtcaattgcaaattaaagattctggaagcattttgccgggacacggtggtatgctcgaccgcttcgacagttcgcttatggccataccggcaggagttgtctacttatatgcactgaccctgttctaaaatcgataaaaaaataatagccgcaaataaaaacgggctacaaacgtaaagcatcccgcagaatatagcgaaacttccgtttgtagcccgttatttacaactcaccctttttacattacctgaacttcgtttgaaagctctatattctttgcaccctcgggtatcggctgttcttttacatcaaagactacctcaacttctccgttttcaacagaattcagtttcactttaatgcctttcttaccggtcagatccaacgaattcaaattaaaagataccgcaccgtttaaacaacgcttagtcacatcaccatacgtattataacgatattccaaatggatatacccgtcatcaccatctttagccatgtttcgcgtatcgcgaaccagactgaagcgatgtttttctttggccggtaagcactggcgaaaaatgatgttcagatatccgcctccaatccacatcatatctttatatacaagaacagggtcattgcctatttccgcttcattgtcggcagtcaggtcctctatttgtttggtcaggacgtcatagttacactctacttttaccccatgatcgtatccttcataattatcataaagaggattgaaataagtaatcacacgctgtccgtctatcggcctatagcccggaatcgcggtcgcagcaggccaaagacttccccaatggtcggcattcagtgcatacgtatcaccaccgactacccggactgtagcccagtctcttgctatatcgcccaatgaataaccgtcaccgtcatcacacgactgcaatgccggcagtatcagcgtcagcattgccacccaaagtagtttaactcttttcatatctattcttaatttattccttttaccctataaataaaaaaaccgggcatttactgcaccggtttctgtcctattattgaataaaaaactattttttaagcaatttcaccatttcgcgggcagcatgcctcggggctcctgccggtccgagcaaccgtgccatttcttcataaccatccaacattttccgtcgatagtcttcttgaaacaacaaacgtttcagctcgttccgcatattctccaccgtcatcgtatcagccaccaattccctgactacttcccgtccggcaatcaagttgaccaacgagataaacttcaccttcaagatatgtttccggaggaaagacaccagcttccctacgggagtatgatagcaaaccacttgcggtacgcggaaaagtgccgtctcaagagtggcagttccggatgtcaccaaagcgacatccgcctgttgaagcaagcggtaagtccggccaaagattacttgcagatttgtcccttttacgaattcagcatagtattccggagaaatgccgggagcggcagccagcacaagctgataatccgaaaaagccgaggctgcccggatcatatcggggagattatccttaatctcctgcttccgacttccggcaagcaaagcaatgataggcttatccgctaactcattatcactgataaaatcggcaaatgtttccggatttgcagccttgaaagcggtaacttcatccaccgtcggattaccaacgtaatgaatcgggtattgatgcccttcaaaaaactcaacctcaaaagggagaatggagaaaagctcatctacatctcttcttatatttttgatgcgatattctttccatgcccaaatcttgggagaaatatagtaataaaccggaatcttcgttttcgcatgcacaaacttggcaatatcgagattaaagcccggataatccaccaaaataacaacatccggcgaccatgccacgatgtcctccttacatctcttcatgttggcaaagatggttcgcagatgcagcaatacagggataaagcccatgtaagccagctccttataatgcttcaccatcgttcctcctacagcagccatcatatcaccgccaaagaaacggaattcagcccgcggatcctcctctttcagtgcagccatcaagtgagaagcgtgcaaatcgcccgaggcttcaccaacaatcagatagtatttcataattcccaggatttcaattcgtccataaaatgataagcagtcatatccactaccgtcggtgtgatggctacatatccgttggccaacgcccaatgatcgttcttctcgttctccggttcgtgatcgataaactctccggtcagccaataataattcgtatcgtctctccgtggacagacctgccactctccgctccagtgccctttggcctgttcgcagattttcactcccttcagttccggagtattgggaaaattcacattgagacaagtcagtggcggaagtcccttctcaagaaccattgccgctattttccgcacataaggtcctgcagcatcaaaatcagctccgggggcatggtcacaaatagaaaacccgatagaagaaattccgttaaggcaaccttcgattacaacccccatcgtgccggagtagtgtacattggtagcagaattgtcaccatgattaatcccaccgacaaccagatcgggttcacggtcaagtatctgatttcgtgccagttttatacaatcggccggcgtaccggaacacttataaacagtcaaccccacatctttctttaataactgataatgcaccggctgtgtcaccgtcagtgcacatccactgccggaacggggagcgtcaggagccattactacgatctcgcccagcggacgaagaaatttaatcagttcgctaataccttttgccataataccgtcgtcattggaaacgaggatcaaaggccttttattttccatacaatcttaccttatctattattttatgttttcgaaatgcacaaaagtagcaaaaagaacttgtatcgacaacagaaccaaataagaaagcgaaggtctattaatattgtattcacagcagataagaaacaagagtgtaaaacatccggatgttcttcacaataacatccggatgttattagatataacatggggatcttgttatcaaaaacatggggatgttttatcagctaactcttaatggaagtcttgaaaccatctgatggttagccatgcagactacccgtttacaaatcttaatcttctgcaagtgagtaaaaaaaggaattgatattcaattttaatacgtatatttgtgagctaaaaagagaaaaaatgcccgtatctcgcctggcagttattaacaaaacaggtgacttatcaacagattaagcaaagtttctattttttagtaggcgctctgaggatttatcacttatttcgctgccaataaatttagataatatgggaaaaataattgctttggccaatcaaaaaggtggtgtaggaaaaacaacgactacgattaacctcgcagcttcgctggctacgcttgaaaagaaagtactggttgttgatgcagacccacaggcaaatgcctcttccggattgggagtcgacatcaagcaatccgaatgtactatctacgaatgcattatcgacagagccaacgtacaggacgctattcatgacactgaaattgattcgctgaaagtcatttcatcgcacatcaatctggtaggcgccgaaattgaaatgctaaatctcaaaaaccgcgaaaagatactgaaagaagtgctgactccgctaaaggaagagtatgattatattttgatagactgttctccttcgctgggattgatcacaatcaacgccctgacggcagcagactcggtgattatccccgtacaggcagaatactttgccctcgagggaatcagcaaactgctgaataccatcaagattatcaaatcaaaactgaacccggcactcgaaatagaaggctttctgctgacgatgtacgactcacgcctgcgccaagccaaccagatctatgacgaagtgaaacgccactttcaggaactggtgttcaaaaccgtcatccagcgcaacgtgaagctcagtgaagcacccagttacggactgcccaccatcttatatgatgcagaatctaccggagcaaaaaatcacctggcactggctaaggaactaataagcagaaatagtaaataaacgaagatatggcaacacaaagaagaaatgcattaggccgcgggctcgacgccctgctctccatggaggaggtgaaaaccgaaggttcttcgtctattaacgaaatagaactgtcgaaaatctccgtcaaccccaaccagccgcgtcgcgaatttgatgaaacggcactggaagagttggccgattcgatcagggaaataggaattatccaacccatcaccctgcgcaaagtctcggacgacgagtaccagatcattgccggggaacgtcgctaccgcgcttcacagaaagccggactggatacgattcctgcatacatccgcacagccgatgatgaaaacgtgatggagatggcgctgatagaaaatatacagcgcgaggatcttaattcggtagaaatcgcactggcttaccaacacttgatagagcaatatgacctgacacaggagcggttaagtgaacgtgtcggcaagaaacgcacaaccattgccaactatctgcgtctgctcaaattgcctgcaccgatacaaatggcactgcagaacaaacagatagacatgggacatgcccgggcattgatcacactgggcgacccgaaactacaagttaaaattttcgaagaaattctggaacacggatactctgtccgcaaagtagaagaaatagtaaaatcactgagcgaaggagaagccgtgaagagcggaaccaaaaagattaccccgaagcgggccaaactgcccgaggagttcaacatgctgaaacaacatctatcgggattttttaacaccaaggtacaactgacttgctctgaaaagggcaaagggaagatcagtattccttttagtaatgaagaggaactggaacgtatcatggaaatcttcgactcactgaagaaataaatgacgaaaaaaagtaaaacatatcagctatacattgccctgcttctctgtttctttcaggtagcagggattgatgtgtatgcacaggagcctgtaaaaacagtccaggattccatctctccggtccgcgaggcccctaaagcacgggcacgccgccatcgtgaaccggtagtttcttcgccggtcgccgacagtgtaaaagtggataaagcggttatcctcccgccgatagacagtttggaaaaccggaaacccgccattgttacggcagacagcctcgaggaagtcaaccggcagaacctggaaaagatagaaacacctgtcattccgtcagtcgtaaagacagatagcctgccgcctcccatcatgcctaaaaaaatgttcgtacctaacccgacgaaagcaacctggtatgccatcgtgtttccgggtggcggacagatatataaccgcaaatactggaaactacctattatatatggtggattcgctggatgcgcctacgcattaagctggaacgggaaaatgtataaggactatgctcaggcttatatggatattatggacaataatccaaatacgaacagctatcaggatttacttccgccaaatcacaattacaccgatacccagctgaaagatatactccgcaaacggaaagatacgtatcgccgctatcgtgacctcagtatattcgctgtcatcggtgtatatctgatttccgttatcgacgcctatgtagacgcggagttatccaatttcgacatatcacccgacctaagcatgagggtggaacctactattataaataataacccgttacaacccggcagtaagtcggtaggcgtgcaatgcagcctcagattttaacccatgaagattgaacaaataagaatgaagaaattagcaaactattgccccctgattttattgtttttgtttgccaccccaaaggtaaacgcacagagtgtagacgtagtgattcgcgacaacggcaaagaacgccaggaaagcatagagcttccgaaaagtatgacttatcccctcgatagtctgctcaacgactggaaagccaaaaactacattgacttaggaaaagattgcagtacggcggaaatcaatccgttgttcagtgactccgtatatatcgaccgcttatcgcgcatgccgaccgtaatggagatgccatacaacgaaatcgtacgtaagttcatcgatatgtatgccggccgcctgcgaaatcaggtatcttttatgctgagtgcctgcaacttctacatgcctatcttcgaagaagctctcgatgcgtataatctgccattggagctgaagtatttacctatcatcgaatcggctctgaacccgtcggcagtatcacgcgcaggtgcaggaggtttgtggcagttcatgataggaaccggcaaaatgtacgggctggaatcgaacagcctggtggacgaccgtcgtgacccgataaaggcaacttgggcagcagcacgctacctgaaagatctatatgatatttatcatgactggaatcttgtgatcgcagcatacaattgcggaccgggcaccatcaacaaagccatccgccgtgcaggaggagaaaccgattattggagcatctataactacttgcccaaagaaacaagaggatatgtaccggcatttatagcagccaactatgtaatgacctattactgcgatcataatatctgtccgatggaaaccgatattccggaaagcaccgatacgattcaggtaaacaaaaaccttcacttccaacagattgccgacttgtgcaatgttccgatggatcaaatcagaagtctcaatccacaatacaaaaaagagataattccgggtgaaagcaaaccttatactttgcgccttccacaaaacgccgtaagttcgttcatcgatcgccaggacactatttacgcccaccgtgccgacgaattattcaaaaaccggcgtacagtagccattaaaaatgacagtcctgcttccagaaggaaaggtagctctgccaaagcaggcaatggtacacccacatattataaaatcaaaaatggagacaccttgggagctattgcagcaaaatatggtgtacgcgtaaaagatcttcaaagttggaacggactgcggggaactaacatttccgcaggaaaacgtttgaaaatatacaaataaatcccctttcgcttgcctgatgtttaaatttgattatttttgcagaaaaggaacgaaaggactaaattatggacactgagaaccagaaagaaatagctgaagagcaaatgattgaacaagcttttcaagaattgctgaacgattatcttgctaccaagcaccgtaaacgtattgagattataaccaaggcctttaattttgccaatcaggcacataaaggcatcaaacgacgctccggggagccttatatcatgcaccccattgccgtcgcaaaaatcgtatgcaacgaaatcgggcttggttcgacttccatttgtgctgcccttttgcacgatgtcgtagaagataccgactatacggtagaagatatcgaaaacattttcggagctaaaatcgcacaaattgtcgacgggctaactaaaatttccggaggtatctttggtgaccgcgcttcggcacaggcagagaactttaaaaagctcctgctcaccatgtccgatgacatccgggtgatcttaatcaaaatagccgatcgtctgcacaacatgcgtaccctcggctctatgttacccaacaaacagtataagatcgcaggcgaaacattgtatatttatgcacctcttgccaaccgcctgggactgtataagatcaaaacagagctggaaaacctcagtttcaaatatgaacatcctgaagaatatcaggaaattgaagaaaagctgaacgcaacagcggccgaacgtgacaaggtatttaatgaattcaccgccccgatacgagagcaactggataagatggggctaaaataccgtatcctggcacgcgtgaaatcaatctactccatctggaacaaaatgcaaaccaagcatgttccctttgaagaaatttatgatctgctggctgtacgaattatcttcgaaccacgcaatatggaggaggaactgaatgattgttttgacatctatgtctcaatctctaaaatctataagccccaccccgaccgcctgcgcgactgggtgagccacccgaaagccaatggataccaggcactgcatgtcaccttgatgggaaacaacggacaatggatcgaggtccagatacgtagcgaacggatgaacgatgtggccgaacaaggatttgccgcccactggaaatataaagaaggaggaggcagcgaagatgaaggtgaattggaaaagtggctgcgtaccattaaagaaatactcgacgatccgcaaccggacgccatcgacttcctcgatacaatcaaattgaatctatttgcttcggagatttttgtcttcactccgaaaggagagcttaaaaccatgccacagaactctactgcgctggattttgcattctccctgcacacagatataggaagccattgcatcggcgccaaagtcaatcataaactagtgcccctaagccataaattacaaagtggagatcaggtggagatactgacatccaagtcgcaacgtgtacagccacaatgggaagtatttgccactactgcaagggcaagggcaaagattgcagctattctgcgtaaagaacgaaaaaccttccagaaagaaggagaagaattgttgaacgaattctttaagaaagaagagatccgtccggaagcagctatcatcgagaagttatgcaaactgcataacatgaagaatgaagaagaattccatgtagccatcggcaacaaaaccatcgtattgggagacgccgacaagaatgaactgaaggagaagcaaagcagtaactggatgaagtatctgactttctcttttggcaacaacaataaagacaaacagcaggaagaaaaagaaccgcaagaaaaagagaagattaataccaaacagattcttaaactgacggaagatgccctgcaaaagaaatatatcatggccgaatgttgtcatcccatccccggtgacgacgtactgggatatatggatgaaaacgaccgcatcatcatccataaacgccaatgtccggtagcggctaagttaaaaagcagttatggcaaccgtatcattgccacagaatgggatacacacaagaaactttctttcctggtatatatttatgtaaaaggcatagataatgtaggattactgaacgaaatcacgcaggtcatttcacgccaactgaacgttaatatccgaaagttggacatggagaccaatgatggcatttttgaaggaaaagtacagttatatgtgcacgatgtggaagacgtaaaagccatttgcaacaatttgcgcaagattccaaatataaagtcagtgacacgtgtagaaaactaatgaaccatcagcgatgaacgataacaggagtgccaacctgcgttcatcgttcctctccgttcgtcgttgaaaatctatcaagggcattcctcattccaagcagttcttctctaatctgcttaagacgattgataatctcaaagttccggattgttgcctctctattatctttcaatttttggcgggctccgggtaaagtcatcccccgttccttcaccaagtgataaatcagacggatggtttctacatcctctttccggtattggcgtaccccacggctaccctttttaggggcaatttgcggaaactccttctcccaaaaacgaagcaacgactcattgacatcgaacatctgggcaacttcactgatagagtaatataatttcagatccctttctgtattttgcataattctctttttgtttagtcaaacactttaccgtggttggcggctatctgaatcatacgttcataatcttccgcacttaaatccatgaagtaataattaaccggattcaccacttgccccttgacatgcacttcgtaatgcaaatgcggtccggtgctctttccggtgcttcccactccggcaatcacctcaccgcgtaccacttttttacccagtttagtacgaaactcctgcaaatgagcataacgggtacgatacccgaagccatgatcaatctcaacagtattgccataaccggtctcccaccccattttcaccactgtcccgtcaccagtggcatacacatccgtcccgggatgagcagaaaagtccataccggcatgaaacttcgtcgttccgtaaatagggtcgatacgtgtaccatagccggaagctgtcttccgaagatctttattagatatcggctggatggcaggaatacactttaacatctggtcatgatttttacacatcgccaccacgtcgtcaaacgacttggattgtatataaagttgcttactcagcacgtccatcttctgagtcgtattaaccaccagttttgagttggccatatccatcagttcttcataacggttcgtaccgccatagcccgcctgacgaatggccggtgaaacgggatcggccataaaaatgaccctgtaaaggttatcatcacgttgctgaatgtcctgaagcactcccattgcttcgtcaagacgacgagaaagaacattatattgtgccaaaagttggctattctctttccgcaactccttctctgaaggagaaccgaaaatcagtaacaatataatgaaactgccggcccccagccccatcccgataaaaagacggcggagaatgctcaatgcccgttgtcggacagtcggataaatccggtcataagtctgcgtttgcggattatagatatagtaaactttgcgcatcttataaatatttcgcttgttaatacggcaaaaataataaaaacaagctatctttgcactgcttttttcagaatattaacctcaacaatagatatatagaagtatgttgactgcaaaagaaaccagagattcgtttaagaatttcttcgagtcaaaaggacatcagattgttccttcggctccgatggtgattaaagatgaccctaccctgatgtttaccaatgcagggatgaaccagtttaaagatattattttgggtaaccacccggcgaaataccacagagtcgcggactcgcaaaaatgtcttcgcgtaagcggaaagcacaatgaccttgaagaagtgggacacgatacgtatcatcacaccatgttcgaaatgctgggtaactggtcattcggcgattatttcaagaaagaagccatcagctgggcatgggaatatctggtagatgtattgaagctgaacccggaacacctgtatgccacggtgttcgaaggaagccccgaagaagggctggaacgtgataacgaagcagcttccatctgggaacaattccttcccaaagaccatatcatcaacggcaacaagcatgataacttttgggaaatgggtgatacaggtccctgcggtccttgctcggagatccacatcgacctccgcccggctgaagaacgtgctaagatttcaggacgcgatttggtgaaccatgatcatccccaggtaatagaaatctggaacctcgtattcatgcaatacaaccgcaaggccgacagcagcctcgaaccgctaccggcaaaagttatcgataccggtatgggattcgaacgtctttgcatggctttgcaaggtaaaacatccaattacgacactgacgtattccagccactgatcaaatcaatcgctcaaatggcgggaacagaatatggcaagaatgaacagaacgacatcgctatgcgtgtgattgccgaccatatccgtactatcgctttctcaatcaccgacggacaattgccgtcgaatgccaaagccggttatgtgattcgtcgtatcctccgccgtgccgttcgctacggatatacattccttggacagaaacaagcgtttatgtacaaattgcttccggttctgattgacagcatgggtgatgcttatccggaactgattgctcaaaaagagttgatcgaaaaggttatcaaagaagaagaagaatcattcctacgcactttggaaaccggtatccgcttgctcgacaaaactatggcggacacaaaagccaccggaaaaacagaaatcagtggcaaagacgcctttacgctgtatgatacgtttggtttcccgctcgatctgacagaactgattctgcgtgaaaacggcatgacagtcaacacagtggaattcgacgccgaaatgcaacagcaaaaacaacgtgcacgcaacgccgctgccattgaaacaggcgactggattattttgaaagaaggcacaacagaattcgtagggtatgactatacagaatatgaaacctctattctgcgttatcgccaggtgaaacagaaaaatcagactctgtaccaaatcgtattagattataccccgttctatgcagaaagcggtggtcaggtaggtgacaccggtgtattggtaagtgagttcgaaactattgaagtgatcgacactaaaaaagaaaacaatcttccgatacacataacaaaaaaacttcccgaacatccggaggctccgatgatggcttgtgtaaacaccgacaaacgtgcagcttgtgcagccaatcactctgccactcacttactggacgaagcactccgtgaagtattgggagaacatgttgaacagaaaggctccttggtaactccggattctctgcgcttcgacttctctcacttccagaaagtaacggatgaagaaatccgcaaagtggagcatttggtaaatgcaaagatacgtgccaatgttccattgcaggaacatcgcaacatccctatcgaagaagctaaagaactgggggcaatcgccctgttcggtgagaagtatggtgaccacgtacgtgttatccagttcggctcatccattgaattctgtggaggtactcacgttgctgctaccggaaacatcggtatggtaaaaattatctctgagagttcagtagctgccggtgtacgccgtatcgaagcatataccggagcccgcgtagaagaaatgctggatacgatccaggatactttgaacgatttgaaagctcttttcaacaatgctcccgaccttggcgtagccattcgtaagtatatcgatgaaaacgcagggctgaaaaaacaggtggaagactttatgaaagagaaagaagccgccgtcaaagaacgcctgctgaagaatgtacaagaaattaacggcataaaaatcattaagttctgcctgccgatgcccgcggaagtagtgaagaacatcgctttccaactccgtggcgaaattacagagaacctgttctttgtagccggaacagttgatgccaacaagccaatgctgacggtcatgatcagcgataatctggttgcaggcggattgaaagcaggtaatctggtaaaagaagctgccaaactgattcaaggtggcggtggcggtcaacctcactttgcgacagccggcggtaaaaatccggacggactgaacgctgctgttgaaaaggtactggaactggcaggtatctaaaagtcccgactctccacgagaagggaaccacgctgtccgaaagtttccatataaagctggaagtcagatcaaacatcatagtctcccgagtaaagagcccggtattgtgccgggctcttcctatttcattcccccttcatcggacgcaaatatcataaactcactttatccaatggcaaagcattatttacctacttcataagtatatatcttatatggctcctgtgtattcaatgcatacaaccgaccgtcgggagagacagtaaaattatcatagattttatcaaataaaaatctctttttcagctttccctcccaatcccatacttgtaattccggtattgctccttcactatatattactttctcagtaactccttgataaaaaagaacgtaaattgcatcatcagtagccacagtcttgcgccaataaggatacacactttgttccctgaacttttcatacgtattatgtctgtccggaatatcctgcaacctgatttcctgcaacagctctccctttatactatacttccgtataagattatgatacaaataaaaatccaatataaccttctttcccatttttcccgctgtaaacttataatcgaatttcgcttgctccatcttctctaaattcgtagaaggataatctccaaaaggggtaaattcccctttagaatatatgaaatgctctttacccgaagctccgtccgttttgccgctcatgatataatgcccatgatccaatcgaaccagctgatttattgcatccgaaacggctatcggaatattatttagtatacaaatgcccctgttttcaatcttgatttctcgttctatatcagaatctaagataaagaaactggaatcggagcttgtaaagtaatcagcgcggggacgaatcagctcattggggcctccgcctatataccccgatgaaaactcatacttcaagctgtctgacgtccagaaagaaagtgtcggattgttttttacctcaaccaatatcaagtgatgatcaaaataaaaaagtccgcgcggatataagatattggtagaatctaagtcaaattcacgaaaagaacagagtcccaactccgcatcattcaaacttatttccttaaaatggggagaggagcaacctgaacataatatcattggcaatatacatgcccaaaaacaaatatatttcatacaatttctttttgaggaagaaaaagtgttttttgatgtaaatcacctttttcccgaaattagtttttcatagtcctgttactatggttgcaataatagcaagaataacccggaaaagcaagaattatcttttttattctactcccactacacggctctttcataccccgccttcttctcatacaaaaaacacgtttcgatcttccatcttccaccttttagaatgcatatcgttgattgtgagatgtatagattgatggaaaatgcggtttttataccatttatcttccacccccatcttccatcttccacccgctgttttaggggacattatgaataaacgatattatgaacatacgttacccattatacgagggagtttatcgaatacttacactggtattgtctcggaatacaaaataaaggaagaagagaacaggatgaaaccacctgtcacttatagtcatccaaagtcagttattgtcatgatacacatgacgggggggacggagatgccgttccgttcggacggttcttcctatgcggaggcgacatcagaggcccgtagtggtgtggaaaagcgagcgggattccgtttccttgtccaccgttcctttttaatccttatgggcaggcgtgagagcgcgcatccgtccggatacggattcttaaattatcggtctatgggagtgtaaaagtattaatccgttaatggagaattatgaaggaagaccataaggtgtacacggctacattctccatttgcagaagtgtagaagtagtaatccattaatgaagataatgcagaaaaaccataaaccatatacggctcactgccgctctccatttgtagatgtgtagaagtaacaatccattaatggacaatagggcatgtaaagggcagatttcccgtatattcgcctccttattcccgaattatggacgtaagtcatatgattatggagagatatccacccttttatggggagagcagccggcaaacacctgatggaaatgcctcgtaaatcacaggagaatagccatacaatgggctaatacacaataattattggataaatgtggtccgctcctgcggacagcaagttgtgttttcgtttaacgaaaacaggacggtttaacggagaatacaccgataaaccgttacttatttcaagctccagcgtcgctttttacatatctaactataattcatttgaaatcacaaaacagattgaaccgaatgtggttagtttgtctgtttatttcatgtccgaatcattagtatgctatgttgcaaagttcgtattcattatgaaaaaatccgcttacgagaacaagatattcaggtaatttgccatcctttccccaaagaagttcgatgttaaaaagttcagaaagcgttttggctatgtcaaatccgaaggcttcgagtgacggacgcactttttccgggtgtcggcatggtgtgccgcagttacgcgtacactcgttatctgagcagtgaagacatttacctatataggcaaatgaacgccctccatatttccgttccatatccaataattcgctctcgattcgtatccgttccggtaaaatgagtttttgtgtatattcaatcggaatatctttgtcttcagggattatcttcgttgccataagatgtgcatacttgtattgtcggagaaacgattccgtatcaaaatcaaatggaggacacccccaacttttaccgtaattggtacattgtttgcaaagttcaagaaaatgtggttcgtcacggaattcggcgatgtatccttcaacagtgatgtctgaagtaaaattttctacagtgtatatactcattgtttcaaaatcattgtaccgcataaggagtcgaaacggatgttttcattttggaaaagtctgtcaatgtatccgcttttctgcatttcagacgcggtcaagcaacttaaattcggggtatctaacaatgctatcgaatcgcacatggacaacgcgatgtcaagttcatgtgtcgagaacatgatacattttttctcgtcgtggacaagcctacgaagcaacgccacaagttcgtagcgattaggcatgtcaagaaaggaagtcggttcatcaaggagaatgataggagtatcctgtgccaatgcacgagcaatcatcacacgctggcattcgccatccgacattttatccatcgtgcggtttgcataagcctccattcccaccgaaatgagcgattgcatgactatctccttatctgtttcttgcatcctacctatccagttggtataaggagcacggcctatggctacgacatccttgcaccgcaggttggcgatgcgcgtgcgctcggtcgtgacgacagccagcgtttttgccatatcttcggttttcatgcaggcgatgtcgtgcccgtcgagaatgatttttccggaataacaccggttcagaccggctatggcgcggagcaacgtcgattttcctgtcccgtttcttccgataagggctgtcagttgacctttttttatcgtggcatttacctcgtggagcaacgagttttctttgtaacctatggaaaaatgctgtaattctatcatgcggtgatggatttgttgcgtaaaaccacccatacgacgattgggattcccaatagagctgtaatggcgttgatcggcaaggtgaatattttagaaatgatgtcgcaaagaagcaatatcgatgctcccgaaagaattgttccgggcagaaggacatgatgatcgctattttggaaaagcattcttgtgacatgaggcatagcgagacctatgaaacctatcggaccgcaaaaagcggttatcgttccggcgagcagcgttgtcgagagaaacaacaggctgcgtgaacgccgaatattcagtcccattgttacggcatattcctctccgaacagcaggaggttaagcggtttgatggtcagtaccgccaacagcagtccggcaaacaccgatggaacaagaatcagaagttgtccggaggtgacgtcacccaaagcccccatcgtccaaatgacaaaggctttcagcgattcctctttgctgaggtactgcaatatctgcacgacagcacctacgcccgatgagaacatcatgcccagaatcaggattaccatgatgtcttttattcgctgtccgacggcagttatcacgagcaacacgacagccgcacccacccacgctgctccggcaatgcctattgatgaaccgatcccggcaagtaccacaagtgccacaccgagacttgcaccggaactgatgccaaggacatagggaccggcaagaggattacggaagagggtctgcatctgaagaccgctgaccgataaggcagccccggccaacagtgccactatagcttttatgaggcgtatgttgagtacgattttttccgtggcacgggaacaatttcccccggtcagtgctgcccatacatcgcggatcagaatgttgacagctcccacggccaagtccagtaaaaaaagaccgaccgtgagcgtaatcaatatggagaataatatagtcgaacgggaacgcatctatttcagttgcttgtaatacacacactcttcctgcaccagttcaggatggaatatcttcacgaggtcgcggagcacgatgtcaggattcacgacggcagactcgtaatagtcgttacccccggctgtgttggtacgggcgttgttgttatacacctctccatttttgaaacatcgggtatcggtgaatttcggacatgatgccttcaagtcgtcaagggagttcgccattcccacgttcaaccacatgtccgcatccgacgcgagcagatatgcttcttctaagtcaatggggatagaagcgtttcccgtgttcttctggtagatatagcggcctcccgcatcagtaatcaagcgggctacataactttgggttgaaggcatgaaccacgagtcgccatagggaacattaagcataaccgaaggagtgccgagggtactgtcggccactttctttttcaaggcgttgtatctgaccgggattgcggcaaaggctttttcacccttctcacgttttcctgtgacttctgaaagcactaccatccattcggccttgccgagaggcgactcttcaagataatcgccgacatacatgaacggtatgtcgagttcttcgagtttgctttccattgcgcttgcgccgttcaccccatagagcagaacgaggtcgggatcgagcgagagcagcaactcgtagttgatgttcccttcatagccgacatcgccaatactgtcgcggcgggcttggatgtctgggttggaaatgtagtcgattcccgaaacgccggttatacaccggacttcaccgattgcgtcaagcatggcgatatgagtggaagacatcgccacgatacgtttggcgtctcctttgagtacctgtcctgcaaacccttcgggaacctcttcaccgttgcggacgataaacagccatgtggttacactgtccgctccctgccagggattcctgacggttatcagtacgctttccttcccgcccgcccctttgatgtcgaagccggaggcatattcgggagcataaagcagcaggttgaaatcattgatttttgagcttttgttgtggcagcctgtaaatgccagagaaagcaacaaaatcaggcttaaattctttaatgcgttcatattgatgcagattatcgtttactatttttgttttttccgaacttgggtgttatgccgatgaatatctcgaaattgatgcccggcatgggacgggacaatacggaaaggtattcttcatcgaacaggttgttgatgctgccctttagcgacagatcggcccatcggaaagagagctgtttttccagtgtcacgttattcatgaagtaagggggcagatagcccgtcagggtatagtcattactcgacatggtataacgctggctgtaataacaccatttgtaaagcaggctccatgtccgccatgacagacgtccggtcaccgttgcggaaaactccggcacgtatggcaactgtttgccgacggattggtctgccggactcatcggttcgctctcgttgatcgagggagtccacgagaaagttccgttcatatccagtttccagtcctttccgagcattatatcaaggtgggcgttggtctctgccccgtaagcatgtacctttttgaggtttctgggggagaagaatcccttggttgtgggtagccagatgatccagtcgtcgatgtgcgaatcgaaccagttgataccaccgctcaaagcatatacattttctttccccaccgagaacgacaaccccacgtcgtatgtgaagccgtgctcgcttttcaggtcgggattaccgcccggcagaaaatagaggtcgttcagcgtgggaaaacggtagttccgggagatggatgctttcgccacgatattgccttttttcgacagtaccccgtcgatgaagaaagccgggataaccggggcccattccgtaccgaacatatcctcgcgaaggacaagcgaggcggcaaaacgatcgacaggccgccatttcgcagaaacggaaccggaaaactcgacacgtcccttgtcatacccgacaacagccttgttaccttcctgcgagatgatatttttgtccgcgctttccaccaaatgctggtgtacggaaacaccggccgtgaacagccatttctctgaaggagcataatccccgtccgcacttccgtagaacgtgttaatcttactgcgtgagcgggtcatcgaagccatttcgccgtttcccttgtcccgcttgtaatcataggccatccatgtgtgtatatagccgccttttacaccgaccttccatttctcccgcacgcgatcccacgagaggacgccgcgaaacgtctgctccctttggcggttctcgaagtccatgtcgttcccgtaatccgtgctgagcatcgccagttcccggttggaattgatataccaggcgtttagcccgaacttgtcgccttcgcccgtgttataataaatttcctgcaagacgtgcagatccttataagccccgctgcggttgcgttccgtcgggtaataggaaccgatgatgttcttgtcctcgtcatagatgttttccttcttgtcccggtttcggtatttgtagtcgttgggggaagaggaatacaccacacgggtggaggactgccagtgtttgtcaccgtaggtcaggcggagaaactcgtcgaacgtgctgaacgaccccactccctgcacgtactgcaacccgaacccttcatggttggccggagaagtggagagcctgaccagaccacccaagccgccgcccgtttcgtttaccgatgacgttccgtgcagcagcgaggcatcatcgataaagtaagaagggatggtggaaaaatccgtcatgcccagcatcgggttgttaatgcgcataccattccacgtcacttgggtatgcgagggagaggtaccccggaaagccacggtggataacgtggcgcgtccgtagttcttgacaaaaacggatgagttgaatgtcagcacatcggccatagacaaggcgatgttctctttcatggcgatggaatcgaaacgggttcgttgcacgcctatatccttcataggtcgtttgcccaccaccgtaacctccggaatacgtagtacccttttggtaatgctgacggaatttttctgctgggcggcaagcagaaagggcaggcttacccccacgaacaatagaataagatgtcttttcatttttgtcctccttcctcgttatttccagcagaaagctcccggaatgattcccacgtaaaattcatcgatcagcttgccttgcggcgaatagcgatacacgataccttgttgctggtaatcaatagcgtcggccacatatacctccccgttgttgggattgaccgtaaggccgtagtatttggtgtcccgaaactccagaaaaggccggacgggaacacggtcggcttccaccggcattcgccaaatatcgttgttgatccagtaaagtgtatcccgtgtaccgttgagctggacttccgaaggccagtcgcccagcttaaacttgaactgtttctctacggtgaaagtctcggcgtctatacgatagagagacggtgcctcgtaaccgtatgggctgccctcgtaaccgccatccgtgatggtccacatcttgttgtatttgtctatgaccagcgaagtaggttgtatgccgatggtcagttcgtccacgaccttgtccgtctccgtgtcgattttcaggatgcggttctggtacgaccagcagttcacatagacgtacttgccgtattgtaccatttgttcggtggaacccgattccatgtccatgtctggacattcgatatagccggtaatctcgtatgtcttggggttgatgatgaagatacggtagtcccatatctgcgtcacataggctttctcatccgacagaaaatggatataccggggtgaggtgaaacctgtgatacggcccacttccttgaaagtattgatgtcgatggcgaaaatcacatgcgagttgttcaccacgatccagcctataccgtcccggataaccatagactgggccacatcgcccaacttgaacccgttggcacggtaaaacacttcattctccacttcgcacgtggcgggatcgtagtaggaaagcgtggcattgctgtactggaaattcccctcgttggtaatgaaaagaccagaggccgatacagagaaatcttccatctctccgtaatcccatttcatgcaactgccgaaaactggcaggcagaaaagaaaaaggcaaatccgttgtattgttctgctcattgtcattcggataaaaaagagtacccgaatcattacgggtactctggttaaggtataaggtttaatcctgctgcgtatattgtttgtccttcatattttggaaggttgggttatacccacatttcgtcacgctccaactttcccccgtaatcattccgttttctataaacttgccgaagaaagtgtagtcggtaaatttcgtcaaaccgtcaaaaacaaccccatgcaaggtctccaacttctccatggaaagtgtttcctgagaaagagaagtcgcactttttatctgtagcgtaccatctatagtctgtaatttatcacaagtaatgcctgttgctttattaacgaacaacccttcacctcctacgtgaagcaattccggaatatccagcgatttactttgtaaagatattgctaacgaaccctctccctctttataatatacaggagaagctgaacaacaaactttggatagtaagggcaagttacaactggtaaaatttccagataaatagaactgtcctcccacttctttcaagactggcattgtgattgaagcaaacatggggatttggatatatccatatccatctatgatttccaagtcgggaaatttggcattgcttcgcatttggcctgtcacatttagatttccatatacatgttgaattgtcgatatggtataatcggtattgttggtggttggcttacaagtgaagtctttgatattcttgaacgtgatttcagggaacttattattcgtgagactggtgatgacaaaatttacatttgacaaatcttcggctgtttcaattttggagagctgcaccttgtttataatttcaatctggggcgctgtttctccgaaggtttcaaatcgggcgttcggcaacagcagtgttccgctcacatcttcaagataatccagcgtgatgcttccaagtgtggtgatcttgctccagtcgggaagttgtttgagtgccgtgaaattctttatctttatctgtccctttatcgttgtcagtttgtccattccaccgaaagcctgaagcacgtcatttcgttggggaacaaaactaccggtaggaggagcttccatattggcttccataataatacttccgtttactgtttcgatttccggaaggttgatggtttccaacatcacggggacggtatggaaatcaaggccaccggtctctttcagcttaaggaagctcatggaagtcagcttggcaagattgtttacggacaagacccctccgacacttgtcagttccggtatttccaaagacgcaatcgaaccggctgctgtgttctcttcattgagtccttgaagattcagatcctgacctacagtagtcagaaccggaaactcaaaactctgtaacgacgacgcattgaacatcacgcttccttcaatagttgccagtttctcgaataggacatacgtcacttggtcgttatataccgatatgtctccggagagcgtttccaatgctttcatggaaatcatgtgaagttccgtagctttcgaggcgacatcggtcgaacctacctgtaaacctccggcagaaacgatattatccaaccctgtcaagtctgcaccgttgtaactgttacgaatgacaatgttgccagtaacctctttcaaagatgccaatgcagatatgtcagtgattttttctgcctcttccgcatcagagccgataatcaggttccctttgacaacggttgttttggttgcggcaaaagaagctacctcctcggtggtcttcaactccacatctccgtcagattctatctcgcttttcacgaccttataggtatattcgcgggcatctccgttataggatgtcacccggaaggttcgttcgttatcccagtccgttaccgtttcaggatcaggtatgattgttgcagaagttgtgtacttgaattccacttcggcgttgttcagcgataccgtatagggaacggttattgttactgtattgtccgtaatgtcggccgtgtacgatttcccgtccacggtcatcacgaccgatgtgatgaaattttcatctgcatcttcaggtataatttcatcgtttttgtcacacgctcccaaaaagaacaaggataggagcatgggaagaaaataaattttcatacttgtaatttttattatttggttagatcctcaaaagaaaatacctccgtagaaacttcgcccagccagccgcttttggccagaacaccgcattgtattttgataaagtcaatatattgcagattggcttccgttccatcggcatggatggcattggaaattttgaaaccgttcctttgtccgcttccatccaccgtactgccgccttctatctggtcgtttccgaaattatccacgtacccccagtcataactctgattatcccaataaccggtttgagaatcttgggtgttgcgggcggccagacaagtgcctgtcagggtataactgttttccgaaatccaagccggataataatagtcttgtgtatgataagcggacagatagtctacccagccgtttctaccgtcggaactgatccattggacatccatttttttgccttccggacggtaataggtcacttcaaaattctgtattgtttcttccttgcctgcttcagatcctttcagttcgtaccactcgtcatccggcaatccgtttccgtttatatcttgcatgacccatacgatacccggttcggaactgccgtcaaaggcgttcccctgaacacagaaatcatattggttacccgaattgggaatactgtggtcgaagccgacgatgatataacccccgaaagaacctaaagagacgtgcagtttgtctttcaaacgctgtgttgcccatgcgacagccgcttcaggggatgtttcgttgccggtcataccgcctatcgtgctcgtctcgttgataaattggccgggagctggggtatattcatagactttattccagagcttggaacttcccgaagcccggaagccgtcttgttcctttttgtccacacaaacgacttttacggtggcagtgacagccgttttccctttgtcgatattcctgcttattttttccgtcggtgtgtcttccgacacagtacaggagacggtgtattctccgggtgcggacggcgtgaacttgaacatgcgttccacttctccttccatgacctgaccgtccacactccactcaaaacggggattgtcgaaatactccaacaacggacgcaggaaaacaggacggtcggcaaaagtgtacctgtccgtggatgtttgcaggtaagacggggtcgggaatttgacaacgtagggcatcgtttccacgacctctacgcttacgtctttcgttgttgtcccatctatattggaagcgttgattgtcaccgtataaacaccgagttctttttcattgaaagtataagtattctcggtggaaacgatttttccttcccgtacccattcgattttgaacccttcgacatccgaatgctgaatatcgggagtaaatgtgtaatcggtattccggacgacttttagcccctgcgaaggtagtgccagtgagatgaccggaggggtgagttctttcacttctactttcagttcctcttcggcatagccttccgcattgtctactcttagtttgacataaaaatccccgcattcattccatgtacgttgaagagacggacccgaagaaaccagcgtaccgtctatcgtccaagcaaaaagagcatcttcaacattctggtatgtcggggcgatagtcaattcgtgatcgaccttgacagtgtaaataccggtctcgctgtcaagttctattataggttgtcctcctacttcttcggtaatgacttcatccttgttgcaggaggtgaacagcatacaggcagaaataataaaatagtgaaaacgatgcatgatgtgtggattttagaaaaataacagggatacccccgacagaagggatatccttgtattctttttattgtatggtgatatcatcaatacagatataagccggagtattcaaaccgtatgctcccgaatccgaaccctcgaagttgaatttcacactttgcaccccttcggcattgatttcccaataatcccatgtcgtgataggatcaacctgttgttggccgttacgataatcggctaaaagacgtttgtaagtgcggatcagaccgccattcgcatcataacattccagattcacttggaaataccctttcatctctttcagaggagtcgctacccccgtagaaccgaactgattaccataagtaatgacaccataagtgtatgaggtgttgcagatccacaggccgaccaatttccggggaacattgaaataaaattctggtttagccatccatgcctgattgtaagcatccacatatccgtaaacgacaccgaaattggaaccgctgtgcccggcttccttattctgtccttccgcttccaccgcagtgttatagacagaacattggtttagataagaataccaccagtctccggtatttcccgactgattggagcggatgttccagttggaaagtgcgatgccgccgctggaatactctgtgcttccacctacagtattaaacattgaaaggaagagatattcttccggagtattgtcgtaaatggtggttacttgaggatacccttggtacgaataaagattttctccggccgaggtaggtcctgctaacatgccgggatcgaaatcatcgaaagtgatagttaaagtaccgtccgaatttgtcacagcacgggtttgcgaagttccggaatcaaccgggtccatcaaaaagtcatcgtccgagctacagccagagaacaaggcggttgcggtaaatagacaggcacctgccagaaagcgtaattttcttttcataggtcactcattttaatgtaaaacatattattaacaaacacaaaaaattcccgttcgtgcggacttacacgaacgggaatatgtctgtcttcaaatattgaatggccgatgagctattccttatttgattacgacccgtatatcccgcaggtgtaaatctcattccggtcatggcaggtcttctgactcgtcccggtcatcgtgccttcccggtattacaccagtggcaaaagttcgatgtccgtttttgtggactcacagcagcgggtactgtcccggattttcaccgggttcccttttcattcggaaggcgtaaacctcccgaaaccatttcccgactgcaaaattatctatattacatatcaattccaaataattcataatatttataataaaacacacaaagcatgacaaccgtactgttttaattagagcattcaagtttacgacaaacgaagacggtaattatcatacacaatatccataaaccaacaaaacagcttgccattttccataacaatgcgttctggaatagataactgttagctgcaattatgcaagcaaaaaaagcagacagaataatgactattaatatcatgcaccagaaattaatcctataaatttatggaaaacaagtaagggaatggaagttccgttgccgcatggatgcaggtgaaggaccttctcttttaacgttggatacgccaatgcacgccaacggaagactctgatattatctgtttggaaaggatataggatgtgcgttactttgtcgcatattcagaatcttaaaaagaattttagtatggaactgacaattattgaaacaagcgcgtattaggagttgagaaagctggtcagcacgctggtcgtacagatgggcgacttccagaaaaagattgccccgcctgcgccggacaagtgaatggatgcgcaggacgtatgtgatggacttatgcccaaacactttctgaagagtttccagcagcatccccttgagtatggccagaacggcaaatgcgtggcgtccgatgtgcggggtgacctcgccccggagttgcatttcctgcctatgattccaagactgagccgcatggcattgtattcacctaccggaaagacacattcggggagtctttcttttcatccgtacccctatatttttcaatcagttcgatagcaatgggcaataattttacgacatacgccactcccgtttttatacggttgcccatcagccatgtaccgccgtcggagtcggtatggatattatcgtatgttatggctttcaagtccacataggaaagaccggtgaagcaacaaaccaccccaatcgcatccaagtaacaaccgcagcaagtgaaacgtaaaccgttgaattataatagatttgctcaatatcgcatccttagcgaaagagggaaaaaggcaaaatatagaagcggttcagctaccaagtcgttacctgttttagacgaggataaacgctgaatatcaatgcttaacagactgcggaagaatgaagaaacatagcccgaaagacagacaggaacagcggttccgacttgcccgggttccgttgcaacgtttcgcctaagttttcatatccggtcaaaagccaattaggagtattattgcaactaaaaatgaagagtatgaaaacagaattcaaggtgctgctctacctgaaacgaaacgggcaggatgcggaagggttatgccctctgatgggacgtatcaccgtcaaaggaaaaacgaactccgtcgcacaattcgcatgcaagttcaaagtgaatccaaacctatggaatgccacctcacagcgttgcaccggcaagagtaaagtagcggtctacaccaaccgtgagattgagaagatgctgctccttctacgccaacggtataacgagctgttggatatgaaggccgacatcaccgctgaggaaattaaaaacacatttcaaggaatcgctacggcacaagccaccctgctgggattattccgggagcacaatgaggaatatgccttgcgtgtgggcgtgaaccggaaagaaaacagtttctaccaatacaagaacacctatcatcatgtcgccggatacattacggacaaatacaaagtgtccgatattccggtaaaagcactggacgaatcgtttatcgaatcgttcgagctttacctccgtattgacaaggggatgcagactggcagttccatcggacatgtacaacgtctgaagcacatcgtacagacagcggtatatcgtggcatcctttcttttaatcctttcaaggaattcactcccctgaaaccgaaacagaagcaactttacctcacccgtgaagaactggaaaagttaatgatgaccacattcgacacgcccaaccggaactttacccgtgacatgtttcttttttcagcgttcaccggaatctgctactgcgacatgtgcaacctgcgagaatctaatatagtcaaggccgatgacggcagtctatggatcgaaacgaaacgccagaaaacaggtacgcccgaaaatgtgcgtctgctggatattgccatcactattatagaaaagtataaaggaatggcaccggataggaaactgttcccgatgttgcataacacgagcttcaatccccacctgaagaaaatcgccaaacaatgcggcatagaccgcaacctttgcttccatcaggcccggcacacatttgccagcgtggtctgtatctcccagggagtgcctattgaaacggtcagcaagataatgggacatcgcaatatttccacgacacagcggtatgcgaaaatcacgcaggaaaagatagaccgtgacgtgaccgcattaagttttaatatagaggacaaattcaccttgcagggaatcgactccgcaccctcccacattctgaaagacgtgagcagacggaaataccgcccgagtaaaaggccaatgaccaagagtgaaaaaagaacaataataaccgataaataatatgacctatgcgtagtacattcaaactgttattttacatcaaccgccagaaaacaaagaagaacggcagatgccccatcatgggaagagtgaccattgacgggaagatgacccagtacaccaccggactagagatcgaaccggacttgtggaatcctgaaaccggcagagccatgtcgggaggtaaacggctggagaaccttcctcccgaagcaaaggacgaggtaaggaaactgaatattcatctggacggactggaagagaaggcaaagaaagcctataacgaaaaggtggaagaaataggatacgtatccgcagagcttatcaagaatgtccttaccggcaaggcgcagacaaaagaaaccctgcttgccctgtttgatgagcacaatgaagagtatgccagacgggtggacacggaccggacgcatcattcttatgtaaggtatctcaccgggcgtaagcacctcgccaatttcctacaatataaatatggaatagaggatattccgctccgccagcttgacatgcagctgatcgaggatttcaagttctacctctccacggtactccggttaaaaaccgtctcactgaacgactacttaattttcctgcacaaaatcgcccgtcgtgcggtaaagcaacgaaccattaagcgtgatccgttcgccggttacaagctggaatccgttccggtgaaccatcgttatctcaccggagaacagtttgccaaactgacgggtgtggagttacctacttaccggctatgccatgcacgtgacctgttcgtgttctcgacgtttaccggacttggcagggctgaccttgccaacctcacttccgagaatatcgtcacggaaccggacggttcgagatggattcacatagaacgtcagaaaacgaaggcggaatgccatatcaagttgctcgatattccaagtcgcattatcgacaaatacaagggagagggaaaggacggaaaacttttcttcgtaccggcaaccagcagtttgtgccgcagcctgaagatgatagaagaacaatgcaaactgggatgtcatctgaccttctacatggccagacatagttttgccacgctcatttgcctcggtaatggtgtacccattgaaaccatcagcaggatgatggggcattcctctattcgtacaacacaaatctatgccgaaataaccaaccagaaggtcaaccgggatctgctcagacttgcggatacgacaaagaatcaatacggtctgcctgatgataaaatgacgccgagagtttaccaatgcggacgttacaacggctggaaagaggaagaagacaaagatgataaccggacatccggcaaggcgatgtagccatgaaagaagaaagagacaggacaaaaaacgggggacaaccagtgaaggctgtccccgttctgttattccaaagccttatgataattatcttccaatagcttttcaatatccgatgctttatacaagattttaccacctaactgaatataaggtatacgttcctgattgcgataatcctgtaggcatctgcgactgattttcaacaacccggaaagctccttgtcagttagaaacttttctcctccaagtggaggacgactgttgtctattattttttctattttcacctgcatctcgttcagtgtgcggaagaaaccggctacacgttcattgcttttggttataatgtcgtccattgtctgtctgattttataagttaaccgttttccttttttctctcaatattttctccttgcgttttaggccgacataagtcaccagtttctctacatcctccgctttgtagtagattttatgctggatttgcgagtatgccaactttccggtatcccggagagtctgtaaagttcgtggggagatgttaagacgcaggcagacatcctggttatccattcattcaccgagctttttctcttctgtcttcttacaaaggtgatccacatgagtggataaattctcaatccggttcatgatgttttcaaagatctcggcttcaatgtaatatacttccatgtttttctactttttatcaaattatatatgaatcttgaacaaaaataaaagagaaacatggataatacaagtaatccattcttttgtccataatagtcatgaatagtcatgtcaagtcaatttttagataatataggaagtaatatattatggatttctaattaattatgacgtcttatcagatcctaagtcgttttattcagtatctatctttttcttttcaattatctttctcagaaatataaggagtcgggaaacacgactccctatatttctgtttattataccccattaatactatattatgtcgaagagaaattctgtataattaataataatatatttacagaaaatattgtcgatttaatcaattagatatccccaattatttactgataaatttctttttattcatgctttttaacaaataataaaaggttactttataaagaaaagaatcacatgtaaaagctatatttaatttgtggcttcaggtctgtgggtacatattttaatatttctccaacattccggctgcactcaattgtgattgggaattttctatcaaattgtgtattgttccaattcatttttgtgagagataatatttctttgcatatctgttctggggactcatcaaaagaaaatagtcttacttctattggattaggaatgtacttaccaggatacgtcccataatactcaacatatcctctagtatacaaaaaatgacgacatttatcaaggctgaacatagtcccccttagtggtggatagtcattatctctatataacctgaagttagtaggcatgatcgttactaagtctatagaattgatattcatatcagaagcgactcgcttaaatccatcgatttcttcctctgaatagttagaacttttgtggataacaagccgttgaggaaaaattttaatcgcattataatattcacttaaagattcttttaaaagattatatgcttgtacctctgttaaatgtggctgtctatcttttttatcttcttttacaggtgtacctcttaatataactccgttaccgtgctcattgaaaatttgagctacacttgtctgaatagttttcttatctcgtgtacggtagaaacttattccagcaaaacaggttatattactgctttcttttttcacagaccaagggatgccacctgctttgtagtataatgcagtataaaagttccatgctatgctcgcttcatcttgcatttctgaagaaggcttggcgattctatccctaaatatttgaattggaatgttatattccatagctttaagtaatcttctgaaatttacctcaatttctactggatcttcttcattaaaatcatcatcaatttcaattgttttagttccatatattattttagttagagattcatctaatacacataaaataacatctggttttttattatttgctagaaaatgtatttctgccaaataaagatccactgttttaataattaactgatcaatatcattggcttctctctttatttggtcaagtgcagagttgttgattttacgtatatacgattcatcataaactacttcacttctaaaagcaatagtttcattaaaacctggaaagtttgtaaaaagattgggttgtttgcttttttttttactcaatatgattacggcacttttttatccaactaatagcaatgtttatgctttcactaagtccaataaatccgataactattttatctggtcttatgtcgttaatgtcagatacattatacttatatatacctgttcgtgggcagatatactctcctttaccgaattgcaataaaggctcttctaataatttaatatccatgttgaggggtataattaagttttaaatcaaaaggtgaagagaatgatatgtatttatattcagattcattatcttctaatttattggaaagacaaaatgatataaacataaaatgttgatatacagcagaatttgtttccaagttctttttctgagcaattaattgactttcttgtttacagctcgaataaccatcataggtgaaagaccatccaggtgttatgctaataaaccacttttcatcagatctaaaagattggattctaaatgaaagctgtctaaaatatagaatttgtttttttcgttattccatatctctgcaactacagttcgtgttgcagttttcttatttttccaagttattttccgttctcttggcacccctataggtttgaatctaaagaacctgtctttgcctacccactgtatgtttttgtaagaagccaactcttctatagaccgattgatcaaatgaagtaatgcttcttcatattttaaactaatatctgcaaattcatttattgaatattcttcaacagtacctatttctattaatttatttaatggctcatctctgttatctaaaggtttaaaagatatgattttatcctcaaaagtaaaccaatccctgctatatgggatttttaataattcaaatgctttactgagtactttccccatgggagctttctttttaagtttatatggagtactccaggattgcgtgattatttcatcacgatctattcctgtgatgcccatataaatcttttgaggtaatactatttgaaggatgttaggaaataatatgtctgtttttatggtttccttattttctaacaaatactttctcctattcatttcttcttcgcaaaactcttcttttaacaattgtaacaaagaatctattttgctaatattaatccaagagtttacttccttaagaatatcactataatctaaaatatgtttctctgagaattctaattcattattatgagctatagcgaaagtactatctgaatattttttctgcttctcggttataatatatataagcaaattatcgtattcttcaaaacgccttccttttataaattcatctattgtatgctttattttctctccagtagcagtagatgtaacttgaattgctattctattgtccgtatcaactaaatctattgcagaagaatttttcacttcattatttatattgactagatttaatccatatacaatgtttagaatgggaatgattacattctccgcatggatattaatgtcatacagatttaaactatttagattttctacttctgctcgaaatctcgcaaataattctgcaattttttctatttcttctttcttacgcatataatgagtcattatttgatacatccaaagttaagcaaaactttgattagatgaattatttctctttgaaaattgaatcacgcaactatatactttattgtaccaacgattgagtataatgaatagttgatttaaaccataacaatctttaatgtgaagattgttatggcaatgtataacttaaatgacaaatccatacttgcgttctcttttctcaaaagcttcttttccaccttctaaaatttcacaaacatgttctcttatgccttgtttatctagaatacactctttagtatctattagagcagccgtattttcaagacttcctgatttatattggaactttatatgattttgattgggagaatctttaccatgttgatttgctataattatcaattcggaatcagctccaacaacgacatttggattatgagtaacaatgattatttgtcgttcaatcttcttttttcttaaatatttgactaaatctttatatatagctctattatctaaactatcttctggttggtctattaatattgggcatgttttatcgctaaattccaataacaatttcaatataacaaaagcttgtttaccttgtgacatactcacaaatgaatccccctcgtatattaaatcaaaagagatattaaaccaattttcagaaagaaattcagatagaacattctcatctcgatttgatgccttgtagtcaatattatcagatagaacatcatttaaaaaaatcatagatatattacttgtatctttcgagtaattttgccacatattttggatatacgactgacgttcccatcctcttaaattcaatcggttttcaagaaaaagttgcaaacgtttattatcataaatgagatttgattttatttcaataccttcatgttttatctttaatatatcaacaacttcaatccctttatttttatatgaaatatgtttttctaataaatcgcatttcaattgttctaaaacagtatttagattatctataataaccaattcattggttatagtctggagcttaacctgctccttctcaactttttgtatcagttctttatattctttgttttttgaactcacatcttgacctttgacaaatagcgaattctgctttgccttttcaatagaagagtttaaactgtacacatcttgtaataactctttaatgtatttatctatctcactttttatattttcaagacagtcatgttggcaatcttgaatttttatcttaagagccacttttagataagatgataaagaaactaattgagtatcaaatgaagagtttataaaagggaaaacttttagcttattcaattcctccatataacaatttacagtttttatcttattcgcattatctgtaataagtttcataatatcctcatacaatttcatctcttctggtgaaatatcgagttgcgattttatacttgatattttttgatttaaatcattaatttctttactaataccttctttatcacctttttctttcaaatctattaacttattatttatctgtttttttgtatcaaaaaccttatttattaaagattgtatttcagctttattatttgaacagaatatttgataatcttgccaaatagagtaaatggatttatcttttaaaatacgtagtatcaaattatcagtttgttctttatcttttgcaatctcatgcatatagttttgacggaagaagtctatatcacgaggtgtatttgcaccgtcagcccataaaacttcaacgttatctaaatgttctttcacaaagtcacattctagcgaatccaattctgtattattaggattagttaccaaagcaatactttttagcaatgtcgatttaccagttgagcgtcctcctataattacatttaaattaggattcaaatgaattgtttgattccaaaaagtgtcagacgataattttatagaatctattactcggtatttttccttatcttcaggcttactactatgtatttttatacgttctggctcaaatatagtttgttttaatccttcaaaagttgtatctgattttatccaagtataacagtgccccaactccttaggagatgttttatttgtgtcttgggcaaatttatgagcatcactacaatgtaataatctcccatttacattttgcgttattagtgagtcttttcctttattagcttgttctacagtcggagaagctgtaaaaacaaaatgcgcattatttataattgtctttttatctgatatagaaccatcccaacggaaatcctcccattcagcttttcctattgctttaaaatatttgccttctagatatttgttggggtcacttccttcgcctaataggttttctatctttgacaactcgaaatttaagttattaaaacctatttctaatggactaagatctccttttcttttttctttaggtatggaagcactaatatgtttgcctaaatctattaatgtatctctcgtaattatacctccccatgtacatccatttggaatgtcagctgaaagatttgctttactacgaagtccttgtaaaaaatggtattgtatatcttgtgggcttaacaagctttcatcagcaaatataatgtgataattaattcgaccaagttccttacttcctacaaattccttaagcctaaattctataacaggtaatagtaattctatgttaggaattcgtccctcttttttatatttaagtactttctcatacccatctaaaaacaggtaatcattaatacctaatactttaatatcagatggcagattttctattctttgaataaattgttcccatatttcgtcgttatctcctccatattcagaacataatgatgcaggagtatgcacatgcaaatcccattttctccattcagagcctcgtgtattcatctctattatatttttaattacaattcttcaatttacaaaattaaataaaatatcgctccattctatgaaatacaatgagaaatgataatttatttttcaccttcagaattgcaatttataatagccaacatctcattaaaccaatatagggtatgccagtttccctgcatgccctactaaagttttgatatatcttttgaattatggcatagcgcaaacgccattgagatttgctgtaactactttgcccgattcatcttttagttgttccagcattttccaattctcaccatccgcagatattatagtataacccatgtaattgttataactaacatattcatgacctaccactataaacttcccgttcttataagtaacagaagttcaattataaactactaccattttgtatcgttgcgcgcttccaatattctccatcagctgatactgaaatacttccattaccaactgaaacatattttccattgccatatgtgactccaataccactttcttgttttactggtgtccagtttataccatcagccgatgaactagttctaccgtatctatcaccgacaaccgcaaattttccgttgcccaatattatacttttccagcagtcatcaatagtatctttaatccatttgtatgattcaactttgaaatcattcgttaaaacagcgatataactttgataaccgactactacatatttcccatttccataagcaatatcataaaaatatgaacttgatatcggcttttttgtagtccaattcattccatcagtagtaaaacaaagttgcccatcatagtagtttactaaaatgaactgtccattaataaatccaattacacaattatccaaatatctaaatacacaaatatctatttatccaattatacaaatatctgtttatccaattacacaataatccaaatacctgaatacacaaatatctgtttatctaattacataattatccaaatatcagttagattacagcttattatctacagaatcagaattatttccagctatttcagtctattttcggcatcaagctctcgacaaaactgcaccatctattgaaaagtacggacacacatcagaaaaaccttgaaaagaaagcaccaagtggagcagtctacagttctacttaaaaacgttgtccccgtagaggggacagcaagttgtgttttcgtttaacgaaaacggaatggtttaacggcatattccgctgccaaccgttccaagatatagaactccggagtcggcatgaaataaaagaaggagcgtatacctgaacaaaaataccttattgtcggtattggagaaaaagcctagataggttaattttacagataaattatatctacattatcagaaaacaataaatactctaaaaatagaggttcccagtattgaaccgtgggtggttattccaacgatatgttgctgttcgatatcaagaaatcgccatggcagatacctattttctcacgtaaagaaaatttaaagactatttttgaaaaacgatttgcaaataaaaggcgggttcccaataagccgaactgtttcttcagtggcaacagatttctcaaaagagatcgatttggtcaattattttttttcgttgtacaaaaaactatatccagtaatatcattacttcagatagaaaaaggctaaaatagaagtttattcgcataaagacctaatcccttaatggtttggaaaataataggacttttcaaaaacggaggaattctagactttgaaattctaatgtaaagcaggctatatatggatgagtttaaaaaagggagaaaaacatatacctattgacgaagagtggagtgggtatgatgagtagatgcctataggattgataagtttactgcatgttttgaatggttttaacggtaaactcttgtgaatttgagtttatttatattaaatatcaagaaagtatgtaggggatatattgaatgttcacgttataattataacgttttagagaaacttatccactcatagtgtaaaggataagaaatataacggattattaatagatttcagcttttgataggatttaatgaaactcatattactcatcatatctcttttatttctgcctttggttatgcagggacaagatgtgtggacaccaaatgattctttgaaattaaagaaaatgttggaaggaaaaactgaaatccaaataaacaaagaggcattaaatgaacttggcaaagcgttccttcctgaaaagcgtctgctaaattctcactctgcaattttgcctattgaagattttcaaatgtacaaacctgatatttttacagggaaatatcccaaatcgacttttaaaattaatggattaaatatatggcaagattcactctcaatgaaaatccatctgtttagcaataagcagttatttataaactctcagttggatacaggagattcccgggtattaataaaacgacatactgatacccacgtagggcttacaaatcgcttagagtatcatatttatagcggttataccattgataaaaaacggactgtagtattgccgactacggctactcaatattatatcggcacaggcttttcttataatattaatagaaagttacagttaaaaaccggaattgaatatcagtataacattatttataaacgctgggaatgggtctggaattctggcatacgttttagtttttgatggtactaaatttctccctattactgtgttgttccataaaacaacgcttcatatgctctactatacaaattagtagattgcattaaggtatgatgatctccgtgttgcaagaaagtgtttttgtccagaacgtatatgcaatctgtcattcgggcaatttccggcttatgggtaatcattaatatggccattctatttttcagtctttgcaggaggcttaaaacttgcatttcatttactttgtccatagaagctgtcggttcgtctattattagaatttccggtgatttatataacgctctggcaatgccaattaattgtctttgtcctcctgagagattattcccgttttcatccaacatgttatacaggtttagattatcgtcttgcaaaaattgctctaaccctaattctttacaaaatattgaaacatcctcaatagaaaccgatttaaacattgtgatattatccgccacagtccctataaatattttagtgtattgcgatacgactccaaggtatgaacgccattgtgataactggtagtttttaatatctgttccctgaaacaaaatttctcccgaataaggtacataatttctttgtaataagtcggtgagggttgtcttccccgaaccgacactaccaaaaatagaaatgaaattccctgttcctacctttatattcagattttctaataatgtcatttgtccaggatatctgaatgatacattgcgacattcaagttcattttgagaacacatatgtacagcagtgtttccttcttttataagctccttctctgttatggtattcaaaataaaggcagaacgttcaaatgcaaccctggcttcctgtatatctactatgtaggaagagatttttattgatgcttgaatgatcatggttgatattgttactatagcaaataaaactcccagttgaatccggcctatggttacataatacgagctcaacataattgccatgattgaaaatatgctactcaatgtaccaatatacaagtcaaaattagcgttggctacctttaggtctctgcctcttttttgtgtactcttatagaaaaatagtaaccttctaaaaaacacatgttctttctgatatgattttatgcatgtcattccagagatcatgtctatagaataggtttctaaggctgcatattcattcatgagttttttttggtggagattgattttcttactatacagatatgaaaaaacagccaggaaaggaatactgaatgctgttgtcaaagcgatactccaatcataatagaataagattaagatggagaaagacataattagcagttctataaatatcgaattaaccagtagtataatggagccctgaattttttctgtgtcatttattctggagataatttctccggttttaatcatcgaaaagaatgatttaggtaattggaaaatctttttcaacagcatcctaatgattcgtacgttaaataaaatattttgcgtgatgataaaacgggagtttgcatatgatgcaagttgtgagagtaagacgaccatgccatatatcaatatataaagcattaaaagctttatattcttttgtggcaatatcgtatcgacaagggcttgtacaaaaacagcagtagccaaactaatcaatgctgtcatacaacttagaatgaaactaaggagcaaaattctagcatctgattttattaaaggaagcaaataggttttgaggttgttcttctttaaatttttagtagatagcgtatcaatatctaatgttccaacagtaagtaagattttagacttccatatatcatccaattcttcctctgtatattgctttattccgattgccgggtcactgataatgaaatgacctgatgtgtagtcaaacccataacaaacgacgaaatgtgtgaaaccatattcattgacaacatgtagaattgccggtaattcacaggatttgaggtcgcataaattcccctcatagccttcggatgctaatccgatctgatttgctgcttctttcagtcctaaaagtgtagctccattttgcgttgtaccacttaaataagtgagatgtacctcgtctatatccttttgaaagtaattcattattgagcataggcaggcaataccacaggagttttgtgtcttctgaaaaacaaatgcgtcttggattttcttaaaattatatttcatttaaaatgtctgttttaaaagttcttttaatgtatcgagggctatccctctgtgtgataacctttcttttccgtcaggggtaaacaaaaaaaggctagggaactcggttatttcatatttattaatcagatcaaaatccggatcagaaataataataaagggggagttgttatctatttttgtcagattctcaaatattttcaatttatctcgattctcgaaagacacaatcagtaaattatattttgatttaaagatatctatatttttatctataaagtcaatctcctgtttgcaaaaatcgcaatcagaatttaaaaagagcactatcgtgtttttttgaagattcaaattctcctgtatattctgtccgttgatatccttgataggttgctctaaatcaaaactggattgtatttgtttggtccttttcgggttaattataaatatgaaagatatgcctgtgattattaacatcactaaacatacgaaagtacagattgtgcgcataatcatagaaatagctttttagaaaagaggccagttcttagagctgacctctttaggttaatttacattgttaacactggctgggatttgccggccaccatccgccgtaacttctaattccaaagcggtaatagactttgcgacacatgcaatgaccatttgcctgcacacggcattctactcttgagccccaaaatttaccacctgtaacctgtgataatgtttcatttgaaatctttttcataataaaaaaaattaaattagtaaattgattataatataatgtctgcaaaagcggacaatattccatatataattaaccctcctccatatattaaactcgtttttaacaagatggctgggtacttaaacttaaaataccggctgatgaggagtgatagaaataaaacgaatacaacttccgttatatttatttgtcccaacagcttaaatgcccatgccggtaattttttcccgataaacaatacattgacagactggtaggagtatatatcatcaactgtattatagttatattgaacaataccaaatattttcaggatgacggatattaaataattaattgaaaacacaatgattccagctaaagaaaacctgatacagtttttaatattcaatctaatatttgctatgttaaagccaataaataaacatagagcaatcagactacatgatattaaaatatgcactggtatccacaaataattatatatgtccattcctctttgcacactcatttcttttaaaattgcttcttcactgcccagtttgtggcctaattcctgataatagaagctatctgaataaataaactttaattcaagagttaatgatatgatatagattgcgatattgattatgaatagaatccataattttgtattgatatacctattaaatgttatatatttcataagttttatttggttatatgtttattaaaaatatcttgtataagagaatgacggcataaatggtataagtacaaatgccttatactgtccactattgttttgataaatgctatatgggtttttatgcccggttacatttaatagggaaaattgccaaattcgagaaccatgtttcaacttcttttccatggtatagttgaggtctattctgaaatagtctttaaggcgagtattgggctcttgtgggatatatttcacaattgacgtatttatatccggatatccattagggatcataggcaaacctatgctggggtatgacacattggatacagcataaggatacccagtcttatactgtaaattcattgacaagcgctgtgttttagttgctgtctttttggtcgtcaggctaagaaataaattaatctggttgggggaatcatatttaaaaggatattttttaccttcaaatttgcgctctgatttagatatagtgtatgaaaaccaaccagaaaaacgatttttgttatattgcaccatgaattccattccataggcatctcccgttcctttactgtaatcaataccggcatccaaatagttttctaaattgtttatccggattaaatttttcatttttctgtaatacgcttctattgagagctcccagtttgttaaagcaaaatttttccatcccaaagatagttgatcagcagttggcacatttttttctttaaatggtacccaaaagtcactttgcatattatagttcgtttcgtaaatggaatgagtgggttgagatgtcctgtcatatgctaacatcaatttatctgcccttcctaagaatttagtcagattaattcgcggctcaagcgtaaatacacttctatctgtgttattgtatagtgaagaacgtaatcctgttccaagtatccaaccattctttttaaattcattgtaaacgtagacagaagcggtccataacctatatgagcctgcaccgtattttaaatttgtatctgcgcttttaatactgtattgctccggttgatactcttgcgatgataagtttataccatactgtaatgtattgttcgtggtaatatattgttctaaattagtacgtaaaccaaattcgtacattttagagtagttcttgaatttatgtatggctttttggttattaaatgttatcttttgattggaataatcaaacttattcaggttcgtataatataaggacgttgacaaataaagtttcgagcgaagcgatacagcatatttcaaagaagagctaaatgttccccagccctgtccatatttgttattgagtttgtcttgggtgaaactttcttctttagttttattgaacatatcgtcatatccattatatacttgtaatgaaagtttgctgttattggtcatattccatgctatttttccatttatgtcatagaaagaagcaactggaactcctgaagcgtttactccacctattgcagatgctcctaaataaagcaaatctatcaacgatcgtctggctgtaagtaagtagctgactttattcttttttataggaccttctaaagtaaaacttcccataataggacctatagataatgattggtgatgttgttttacattaccatcttttagcatgagatttacaaaaccggatagtttatctccatacatacttaggactccgcttttatatagctctatgcttttaactgcatccggattaataaaagagatgaaaccatatgcatgattctgattataaataggcaagccgtccattaagaataacgtctggtcactattacctccccggatattcagttgtgaacttccttccatacctccggatacacctggcaaaaattgtattagtttaattggatcattaattccgagaaataagggactttgatttagttttcccatatccaattggacattaccaagacttttctgcttgagtaactgttctttttgacgaattattacctctggcaaatttatgatgtctggttgtaattcaataacgattgtgctatcttgcttggatgcctctatcatgacatgacaggtttcatacccaatgtaagatatttcaagcttaaatgggaattgtattttagtgggtatagagaaataaccttcactatttgaagttgtaaaatattctccggatatgattgttgcgtaaggtatactttctccattttggctatccttgataattccattaatcgtttgtttccgagtctgtgctaagacagacacgttaattattagcaagcaaagtaaatttaaatatttagttttcattgtttattgtctgattgattagtaattgaaaacaggtatttcgtcacagatctacctgcaaagattcccaatccattatttacattactatagactgtagaaggttgaaaaaacatacctgataagtctccgctgcttgggattgacaacgcctgataataagtacgacaatattgatcgtattcgttactagcattgatgatatcgatttcaatcccagtcattttttccgatactttttgttcataaaatggcacgaactgtagttcatccaacaaaggaacattcgttttttttattcttatgaagcttttgtaaaatccagtaattgcgatattgttgtttacatagctaccttcttctctattcacattgtcaattaacctgttatagctatataactcttgatattgaacagttatgtcttgttcatgtaatgaagaagccgtaatccacaaactattgccattatgcttctcagaaaagtctgataatgtcaccatcgatttctcctgatcgaacccaggtttacatgtaagaagaggtggaatttttgtttcagcggaaatttccataaacccatcactttgagctaaaatagtatatttctttccagctttaggcagataatccaactttaattctccttgattgattattccctgataaataatttgcccgtcttctttaagagttacatttacctcttttgcaggatcatatttatcgtttgatttacatgtatagaacttgcagattattggactttctgtttccagacaggcacttagcactaatttattaattgatgacgaaggaatatctacgtcataatcaatcgtgcatgcacttactaacaaacaaagtaatagaaaatgtgttgcttctgataatgcctttttcattctgctatttaattagtcgtttgttattagaacgcacttataattcgaatcccctattaataagtgttaaagcggtgactctgttagtgattttggcaaattacttttgagggcggcctaaaaaaaacgaaggatcgttattaaactttaagtgtgtagataatatctagcaagccattaaaatctatgtacttttgcaaatcataaaagtctctatgcctatggttaatagctaaaaaacattcagaagaagtgctataagatgttataatacaatgatatatggtagacaaaagaaaggaagagtttaaaagaagttttgaaaaatattatcctgtgttatgtaatatcgcatatagatacctgttagataaggaaacgagcgaagacattgttcaggataccatgttaagtgtctggcagaataagaaggatttattacctgagagtgaattagttccatatcttaaagtttctatcagaaacaattgtatttcatttttgaggaaacagacttttgaagtactttcgatagccgatgaaccggtttcccaaaaagtatgttcattgactgaggaatgtgaagaagaaggggtggcaagttctgagaaaatagaacatcttttgggtgtcttgcctactaagtgctcgcttgtattcaggatgaataagttgcatgggatgaaatatcgggaaatagcagaggaacttaatatttctgaaaaaacagttgaaaaccaaatggggaaagctatccggttattgcgtgattatgttgcttcacatccatatatactaattttatttttagttttatctgatattattcttaattagacgcttatgaaaaccccggaaaacataaatgaacttatagcgaagttttttgcaggagaggaaatgacttctttggagaaagagcagtttcaagaatggaaaaaagagaataatgctgagtatagtaagctagctgggttaattaaacagtttgatagctcagaaccgatcattaatgtcaacacttctatggcctggcagcggatagatgcaaaactggaatcacatccaaagtctgcgtttaaggctatggttgttaaaataactatggttgcagcttcttttttgctactattagggttatcgttttggttcctacagaaagaagaagttattagatataaaggtagtgatacgcaagtcgtagatgtgattttacctgatgggtcttcagtgaatcttttcccaaaatctactttagaatactgttttaagaaaaacacgagggatgttgtgcttgttggcaaagctttctttcaggtaaaaagggatacgcttcatccttttttggtgcaaattccggatgttagtgtagaggtactgggaacatcttttctgattgatgctaccatttctgaccagtctgctgtttttgtaaaagatggggttgttaaagttagtgcttatgatcaggacgaaatcttaaagcgcaatcaaaaagcatttctaacaaagaacaatactctatgcagagataccatattgaatatcgctattttcgagttggggcatcctgtaataagtcttagttttaatagaacacctttaaaggaagtaattaaagagatagaaaaatcttataatgttactatcgaattgagggatattcctgaagggaatatgataactacagcattctttgaaaatagcatagatgaagttctgaacgagttgtcttctttgtgccatttgaaatataataaggtttcagaccggcattttgtgttttatactgaaagataagtaacaagtttaatgaaagcaaaagctgtagcctacatattgtttttctggatcttttgttttaatgtcatggcacaggataaagataaaggaagtataatggaagaggttattagtcttccattttcctctgctacgatctcagcatgtttctcattgattaaaaaaaaagacataatcctgtcttacaatgagggaatgatagatataaataagatttgctatttcagccagaaaaacattaaagtaaaagagttactgactaatatcctgtctgattacaaaacaactattgtagttgcaaatcctcgtaagataattatcaccgtagaccgaaaaaatatctatcagctcaacggagtggttagagagacagagactttggaaaaattatacggggctgtattgttctttaagaaaaatggcattattgtttcgagttgtatcactaatgattccggttttttctctactgctcttcccgaagggacctataatattgaaacaaactatttggggtatttaaaatcagtgaagatagtgactctaatctgtaatcaaagaatagacatctttttaaaacctatgatgcttgaattgggcgaggtggtcatttcacctcaacggagttctgccaatgaactcagtacatcttcaccaccgaatatgttatcttatagtaatttagatgttttgtctgaaatgaaggtcttccccggagttatcatgtctcgttctggtgctgatatcaatgttaatggaggaggcagtgaggaaaatttaattttgttagatggtgtgcccatttaccataacagccatataaattatatgcttccggttttcaatggtagtgtaataaagaatgtaaacttatatagcagttactttcccgcccgatatgaaggcaaactatcctcaatactggatataaaaataaaagaaggcaataaaaagaaacattcgagaagcttgtctctcgacattccttcagtagccgcaatgcttgaaggtcctattaaaaaggaaaaagcttcatatatggttagtgggcgtcgtagttggatggagttcctggacaaagctattcctgccagtaagcgtgcaaattatactttttacgatatctataccaaattgtattgggatatatctgcaaaaacttccatgcaaatcagcacctatcataccattgatgaatattattctcctattccggaaggaaagaaagataaaataatccattgggctaatggaatgtatgctttaaagttatcttgtcagttaggagagaagctttttaatacaacccaagtggcttacactcattataccaataaagcgcatgcagatattctcggttttgaggcagatccttatgttactgcaggtataaaagaagtttctttcaactcctcttttaattgccacttcaataataaagttttgatggcttatgggattaagggaactcattctgtttttagtaatattaatgatgaccagcgaactgaaaaatcagatataaatcaaatatccgcatattatgaaaataaattcagtctgtcttctaaatggaatattcaaataggaataaatacagttatatacatgcccaaaggtggtaagcattattcgaatctccagccaagattttccatggcgtataattggggaagagatgtagttagtctggacatatcacggatggcacaattttatcattattttcgattctacggtatggattttccgacggatcttcgtatgccaagcatcaatcaatttaaaccccaaacttctgtgcatacagagctggggtggaagcactatttaaatggaggatatacaaatgcatccatatattacaaacaacgggataaaatcctatttgtaaatcctgaagcatattattcaagtgagaactggaaaaactttcttttggaaggtagaggtgaaagctatggcctgaaactatcttttttcaaaggctgggagaagatatcagtgcaggcagcctatacatggtccaaaagtcttgagtcatatactggttttaggaaaggacacaacataccatcattatatgatattccccatgtctttaactctaccatatcttatagattgacagaggcttctgctttctcgattggcacacaattacatagcggacgtgtaattgtgaatattcccaaagagcctttggcctcgatggatgaattgtatacaaaaagatatccattcagttacaaatttgatataggttatacctatgtcaaatattttcctcgttccaaaaacaagttaacacttcgtttgggaattcataatatattgggtaatcctattaaagaggagatttctaatttttataaagtaaatttaggacaagattgcattccttatagtggaatcatattgtctttttaaacatcttacattaatactgaaaacactctgttccagtaagggttttaattaagaatgtttcagttctctctacttgggtctgatatttgtttctttaataactaaatagacctgagtttggaatttatgggttattattgcatgatgtattgcaaaaaaatattataacgttctctatccaatgcagatcaatacaatagtaatcagtaacttttggttaattgaatagaaagtaggaaacgcctagataatgataggtgtttttgttagtggaaagtatgtaactgcctttttatcaaatagccatacaaatctttttacaaattaaaagatttattctatttttcaagttaacgaatagtctaaattacttaaaatagtttaattacttgtatttcagagaatgttttatacctttgcatcaacctaatgagctatttgatagactgaaaacaaggcagaacgatgcagaagggtggtttctaaaccgttacctattaatcaaaaaacaaagagtaagtttttgatttacagagtaatatttattagtgcaacaaatgtgaagcacatgaacaggaacatgtcgcgcatggcacgctggcgtttgtatctcggttctatatggattatcctttgcagttcctcttcggaaaggaaagaacgcctcttgtattcgggcatacactcgaatgatgcgaacggatgaacccgtatccagcctttttcctgcgcgatatacatcagccacttcaaggtattgacacgcccgaagacagtggagtttgccaaagcgcatgtaccgagcatccagttgtagtaatcctcgatgaatgatttctcaagttcttcgatgacaatatcctctgcattcttcttgcttttcatgaaaagcaggagactcttgtaatcggcaaccagaccgcagtaggtgctttcggctttctctatgccgattttctttttatacggttccagttgttccctgaaaaggttcataagggtgtggcattcctctgagaagccgacatagcggttatagactttcttggctgtaacaaaactgtcgtggtcgcagatgtactggtagtgcctggtgatttgcgccttgatattgtcaagctcctgattgagtgtacgggcctcctcggacttgcctttggcccggttggttttgacgtcccacaaagcgagggacacttctttcttacaactgaaaccggcttgggttccattgatggtgatacggcccataatcggtgtctttccgttttttacagactgtttattctcaaaacacttagctatacatggtctgcgataagctaagagagattccccttacacaaaagcatggcatctccttgtcgtatctcgcctttatacttttatgtatagtagtctaccggatcgaatgaacaagacctatcccatacataaaccaatttagactgctatgttatttttgaggaagaagatggaatgagaccagataccctctttaaggctgactgtaagtcgattaaatgtagaaaaagattgcttttgtcacaagtaaagtgtatatttgcattgaaagaatcgttctttgacagaggcaaaagaaaacagaatattgtaattcgctcgtttctaaatcgttacctgatattaattaaacagaaataactgtttaattttcaattagatagagattgtatgatgtttcgcggtgtatgaactgagcctgcctcccagtttcaactccaccgaaacccgttccaactgccggttcaggttacgcagggcacattgatattcctgataaggggtgggatttttctttgtatgccgctttcgggtacggggttgccccaggataggcagcagatagctcggatggcagttctcagccatcctcctgttaataatttccatcgcctcatgcggtacgataatggtcacctcctgccccgtcttgtggcggcagtaggtcagcactcctttatcgagattattcctgcgcaagtgagccagatcgacaaacgggattccccgaagcataaacatcagcacaaaccagtcgacggctttccctgaagcgtctccgtccggatgtcctgccatccggatcatccgccccactgtccccggactgacagcacgtttcacgtcggagcgcgtaccggtgtataccttatcgaaaagcccggtcacatatcccgggcggcctttcatccccctgttgtagcccgcacgcaaggcacgcatgtaagtcgataccgtgttccagctcaaccgttttcccagtagccaatgttcatacttgtccagaaacaccggactcacctcttcgaatccgatctcctcttttcctgcactctccctaagcgtacgcagcatattatggtagatacgccgggccggttcacgcccctcttctttgagcctttcgatctcagaaatcataaatactgttaatgtttcattcatcttatccattgtttttagtttacaaatctcctttagatataaattgtgtaaatagccggataacagaatctatatctttacaaaaaacatctaaagaaactttgcagaacaatccccgggacgatatgctatactctttttgtatatctttgccgatcctaacgtcgttttaacaaacattggcatccgccatcccatacaaacctcaaagtaaaatgaaaaagagcatccaggacctgaaagagtcattaagaaagaaggaagagaaacaacagcgactgcgtgaaaaagaagaatcgatagaaaaagacatccgtgtgctgcgctacctgatagttagggaggaacaagccgcctcaccacaagccccccggaaacgaaaaatcacccgaaaacaggtaggcagctttttcagccggatcgccctattttatgaagacctgcaacgacgcctgaacctccgcatcacttaccgctgcttctgccgctggctctgcacccgctacgagtttgagtcacgctatcgcgaccgccacaagctgtcgccttgcacggtactgggatattttaagagagaaaggggtggatgaaggggaagtagcctctgctctttaatttcgtatcgcccgtacacttctgtgagaatccgtgtaatctgtggtgagttatcctcctatcacccacttcccaatattccgttcttccttctcgaaggctacacccaccttcactactttccgcccgtccgactgatagggcagcagatatcccttttcatcaatctgcctcaaggcagcctcggcgctgtcgttcagcttgaactcaaacacgtagatgtagtccggtgtcttcaccaccgcatcggcacgcccccgggcactccggacctccgtctccgtaaactgccccataagctggaagacgaggtagaacaccgtctgataatgccgctccgtgcggtcgttcaggtcgtagggaataccggcaaagaagcagcgcaggcgcgtgaggaaagcgtctacatcgccgctctccaactcgcggatgaacttgccgatatagaacgaggtgtctgtctgggctataggagtgtagaagggactgacgaagttgaggaaaccatatttcatctcctcgttggggaaccccagcgtgtacatccggaagcgctcgtcgtagtccttaatcgtcagatatccgctctgataaatcatgggtatcggattgtttatatccgcgcggtcgtcgctcagcgaagcctcattcacctcaatgccctccatctcccctcaggtcgaaatcggtcttctgcagcatctccaccaggaaggtgggcgtgccgctcgcaaaccagtaattgccatacgaacgcttctgcaaggcactcaacacgctgaagggattatacatggaggtgaattcctcgtctttggtgaaccggtatccgtcatattggcgagttagccggtccatcacctgccggcaggtcgcattacttttcactgccaaggcttccaattcgggaaagaaggtagcttctatctccgcacgggtcataccgcagagggtgttatagtcgaggtcgaaactgatatcgttcagttggttcagattactgaaaatgcccatttgcgcgaatttggtcactccggtgatgaagacgaactgcaaccaggggtcggcatctttgagcacagtatagaaagcggtcagcgtctccctgaaatcgtgttgcaactcctgattgtcgaacgaacgcagcaagggtttgtcatattcgtcgataagcaccaccacgcggcgccccgtctgttcgcaggcgcgccggatgacggtcatgaaacgtccggagtgcgtaatgccttctcctcccgtccggtataactcttcccactgccgcaactgccgctcaagtatatcgaccagcccctcacgactgtcatacttctccgcattgaggctgagatgcagcacgggatattgcagccactctttttccaatttctcgatagccaatccgcggaagagttccttcttaccttgaaagtaggcctcgaaagaagaaagcaacaggctcttgccaaagcggcggggacggctcaggaaacagggattgcccgcttgagccagccggtaaatcaatgcggtcttatctacataaaggaaattttcggagcgcagtttctcaaaactctgtatccctatcgggagttttctaagcggggcattgatcggtgtatccatggggcattgaagttagtcttttgcaaatgtacacaattattttttagattctcacacgtggttacaaaaatgtaagggatgcaacaattgtcccttctttattatccttatacccatagatacaaagataacattttcttttcaccacagaggacacagaggacacagagttttaatctcttgtttatatatcctctgtgtactctgtggtgagccccaaatacaatcaagtcagcgctgccataccggttcctatcagagcacattccggtaatggagttcctgctcgcgaactatctctcgtaagtggtatccgcaaagaaactttgcaaacggcggaagaaagagtcatagtctccggcgcgaatctcacggacaaacttctgaacttcaaacggagcttctaccttatcggtattcgcatagtagggaagcaggaatttcatgaacccctcctccacttcacggttcgggaatcccaaacggtaaattccaaattcacggtcataccccttaatggtaaggtaaccgctttgataaatcacaggaataggattggtagaggaagagtcgatgctgttcaatacatccgcatcggtttccacatgcgccattttatgaagatcatagtgatgcatctgcaacagttctaccaaataggtaggagtacccgtttcaaaccaataatttccaaatttcattttatagaacgtattcagcaggctgaaaggattgtaaatgccgatcgaatcttccacaaaatgatacccgtcatagcattccttcaattcacggcacacctcttcataacccatcctctgcctgtcggcaagttcgtacaattcttgctccagattagtccgtatttcctcttcagtgatgccgcacaatgccacgtaacgttcgtccatcgacaaatcaatcagattgttcaaagcactgaacacactcactttaccaaacttggtgacaccggtcagaaaagcaaaccggatgtatccatccattgttttgatggctccataaaaggcttgcaacgtcttgcgaaactccttttgcaattcttcatccccgatggattgcagcataggcttatcatattcgtcgaccagaatgactacacgatgccccgcctgcttgcaagcacgctctatgacaccggcaaagcgcagagacaaagagcgctccgaaggttcggctccatagagtttctcccatgccacaattgctttctccaatatatcctcaaggctttgcagtgagtcatatttctctatattcaaatccagatgcaatatcgggtgttttatccattctttctcgagcttttccatcgccagcccttcaaagagctccttttttccctgaaaataggcttcgagggtagaaacaagcaaactttttccaaagcgacggggacggctcagaaaataataactcccggtctttaccatttgataaaccaatgctgttttatcaatatagaaaaagccccctttacggattttctcaaaattctgtatcccgataggatagattttattgctcatattcttttattccggataaataacagacaaacttataaatacaaagataacattttcttttgtattttgcgtgttgtgtcttaaaagaatggttttgagttcaattcaccacagaggacacagaggacacagagttttaagctcttgtttgtatatcctctgtgtactctgtgtactctgtggtgagcccaaatacaatcaagtcagtgctgcaataccggttcctatcaggttggcattgctcatgttattgatatgaacttccacatcttccagttggagttcgcgaagaagttcctgcaatttctccatcacaagaatgttgtaacttttatctttccggctctcactccagaagaggcttccttcggctatcagacaaatccgatgaatatctttgttgtatgatttcagcaatgcgatcagtccggcaagggacgcggcaaccagttgggccgatctgctatagatccaacgggccacctgcacatagatatctttgtggatatccggatagttcatgatggcagtcagcttccgggcatcgaacttttcttcaaattcatccaacggaaaggccgctttcaagatatcccctaaatacatgccggacaccgctttctcaaaacgctgtttgcccatgctgtcggacattgcatccaccgtatcatccaccgctgtcaagaatggcggatgaaagttgcccgactccagattgacaggaatcaaaccctctacgctgtatgccgggtccagtttctttatcttgtcggcgggaataaaagtggccatattcgtaccggtcccgacaatcaggccgatataggcgtcgtaactcttgtcggtaagcccggcaaacaaactggcgatcgtgtcattcagaactttgatgcctgtaaactttattttattcttttcattcagatagtcgagtaaaggtttccccacaaactgcccgaccattctccggatatccactcctttggtccaacgaagcagctttgcatctcctccgggcaccgattcggcgggataagaaaaacaatagccaacaggcatttcctcttcccgttttatctccacaatcagatcggccagttctttgaacagttcttcgcgcgtatagccgggcgacttcatgacggacatatctttcttccagccattgctggggtagatgaccggcttttcttgcgtgaaatcgacaatcgccacccggtagttggtacctcccagatcgaggactaaggccttccctctgacgtcggccgccttgggcagaataaaggtgggaatgcattgtatctctgcattttttttacttaatccttcttccactttctcccggaatgcataggcaatccctttgagttgttcgttgtccagtttaaaaatattcttttccatggtgttggttttatgtatggatgatctttatttctgtaaataacaactgagaagggtttttgctcaaaaccgatttcaccacagaggacacagagattaattggctgctattgttttctttgttacgtcaagtcccttagggacacagagattaattggctgcgctctatttgttttcagacgaaagaacagatgaaccaataaagaattatctgttcttttgttcttctgtctaaaaaaactctgtgtcctctgtgtcctctgtggtgaaagaacagaacaaaacccatgcaagcatttagttccgtcacatagtaaaaaagtctttctcgataagcagagaatatgctactttgccacgtaaacaaaaacaacaaaaaagaatgaaagacttaaattttgactggctgctgagtggaagctgcctgctgtcggacgtggcgatggcgtattttacaacttgtgtttatccccgctcggcgggcagacagatgcgtgagcagatagaacgatatccggacttgcatgccgaactactggaagcaggatacaaacgctccaatacactgctgacaccccggcaaatctgtatcgtgatacagcattggggaatgcccgacacggtgtaccaatggctacgcgaacatccggaggatcgggtccaaaaactgttcgccgatcgcaaattcgactgatatatgttaatatatctttttgcttattatttatttatgtgcaggtctgcatgttggcggcttccggaacatcctccataaacatctgacggacaacggactacaagcctgaaagcatgttggtgtccgtgttggtgatttggaggctctgaatgacggcaacagagggtctgaaagggtgaaaacaaggctcggtttcaccccggtagagtgtgcgtaggacggcaatagggatcaccgtacacttttgcaccaatctgcaccaatcttttgcatccttgtccttctatgcgtagctttgtcatgccgttcgggaaaggacggcacattcaataacctttaaaacgaaattccatgaacgcaccgaccgagacaattctgaaaaaaggatatatcctgattcccaaatccatgatcgaagatttcttcaaaaccggatcgcaaaccgagggctacctggaagcatggatacaggtattgacgcgggtcaactactccgatacggaggtttgtgtacaaggcaaccggatcgtttgccggcggggtgaaaccgtatatacctacaaacagtgggaaaagacactgggatggagccgataccgcacccgccgcttcttcgaaacgttgttcaaatccggaatcatggaggcggtagagaatcccgccggaatcaccctgctccgggtaacagactatgacctctggaccggacataaaaaagccgccaccacccgggacagccatgcgacggaaggctttgccggcttctgggatctttatcaccggatcacccaaaaagataagataaacatagcccgtgcccggaaagaatggaaaaaactgacggtaacggaaaagaaactggcactggaaaacatcgaggagtattacacccaccaaaaggacatacgcttctgtaaacaggcagccacatatctggaagataaggcgtttctgaacgaatacgaattttaagattattcaccacagaggacacagagggcacagagaaatttctctctcttcaatatcccataataaaagcttaaaactctgtgccctctgtggtgaactataccccaaaccatataccatccaaacattatgttacaaccccaagcacccgaactcgaggaaaccatcctcggagcctgcctgattgaaaaagaaggcatggcactgattgacgaactgctgaaaccggaaatgttctatgtcacccgtcatcaattgatttacgccgcattgcaggcgatgttccacgccggtacgaacatcgacatcctcaccgccaccgaggagcttcgcaaacgtggaaagctggacgatgccggagggccgttctacatcacccaactgagcagccgggtggcaagttcggcacacctggaatatcacgcacgcatcgttcaccaaaagtacatccgaagggaaatgatcgtgggattcagcaaactgctgacactctccggcgacgaaaccatcgacctgacagacacgttggtggatggacacaacctgctggacaggctggaaggggcatgcgggcacaacaggcagttgcgcgatatggacacgctgatgcaggcaaccctgaccgaagcggaaggacgcatgcagaaaaacaaggacggagtgaccggaatccccaccggactggccgaactggacaagatgacaggaggatggcaaaacagcgatctgatcaccatcgctgcccgtccggcagtggggaaaaccgcctttgcactccatctggcaaaagctgcggcagcggccggacaccacacggtggtgtacagcctcgagatgcaagccgagcggttgggcgaccgctggctcctgtcggcaggagaaatggacccatacctctggcgaagcggaaagctatcacaggaaacatggctacaggcccggcaaacggccggagaactggcaaggctccccatctgcgtagacgataacccggatatgagcatggaccgtgtacgctcgagcgcccggttgctgcaaagcaaagggaagtgtgactttatcattatcgactacctgcaactgtgtgacatgcgcaccgaacaaaccaaccggaaccgggaacaagaggtggcacaggcgagccgtaaagcaaaattgctggccaaagagctgcacatcccggtcatcttgctaagccaactcaaccgtggctccgaaaacagggcgtacggacgtcttgaattggccgacctgcgtgagagtggagccatcgaacaggattccgacctggtgctcctcctctatcgtccggcactggcacatctggcaacagacaaacaaagcggatatccgacggagggactgggagtagccatcatcgccaaacaccgcaacggggaaacgggaaacgtatacttcggacacaacaagagcatgaccaaaattggcgactacgttccgcccatggaatggataaaaaagaatgccagatagaggctccgttttcttaacctacacatcgttattttcatcattttacttgactttgcctgtttgatttcgtatctttacgtagtgattgagacaagaaatttattaacctaaaccttaactttttattgtatggaagtatcagtggagcgctatcagcgcaagaagtatgtcagtcaggagaactctcccgtgttgtattacatccgccagaaagcgggaacagccaaaattatggatatcgacgcactggcggaagatatccagaccaattgcgccctgacaacgggcgatgtgaaacacaccatagaggcgctggtggaacagctgcgaaaggtgctgacgcagggaaacaaagtgaaaatagaaggactgggaaccttccacatgacgctgacctgcctgccgggcgaaaccgagaaggagtgcacggtgaagaatatcaagcgggtgaacgtgcggttcatacccgataaggcaatgaagctggtgaacgccagccggagcatgacccgaagcccgaacaacgtgacgtttgccatggcttcggcaggcgctccggaaggcggaggaagcggagacgggggcattgtggacgacccgacggcataaatccgcaccacagattactcagatttacacagatttaaattttaaattcgattacagagaaaataaatctttatctgtgataatctgtgaaatctgtggtgaaacaacgaaacttaatacagcaaaaacaatgaagaaaatacaaaaaatactggaatgcctactggcattcctgatgtttctccgcggggggaacaccgaaaaatagaaccggaactatgagagaaatcaatctgattgttattcactgctccgcaaccagagaagaccgctgcttcacggagcatgacctggaggagtgtcaccgaagacggggattcgaaggagcgggctatcacttctacatacgcaaggacgggaagatcatcactacccgaccggtggaacgggccggggcacatgccaagggattcaacgcacactccataggcatctgctacgaaggagggctggactgcaacggacgacccaaagacacccggacagaatggcaaaaacattcaatgcgggtactggtgaaagtattgctgaaggagtatcccggaagcagggtatgcggacacagggatctgagtccggacctgaacggaaacggagagatagaacccgaagagtggatcaaggcatgcccgtgctttgaggtaaaagaggaaagcttttaaattcaccacaaacttcaccacagagtacacggagtacacagagttttattgctaatgaacggagctcaccacagattacacggattatcacagattgagaaatagataaatctgtgttaatctgtggtgaagtttgtggaatcagcatggcactgaccccggtaaacggtaaacaaaaaaaggaagctgaatcaaatgattcaacttcctttttctttgagcggaaaacgagactcgaactcgcgaccctaaccttggcaaggttatgctctaccaactgagctatttccgcaatgtagtgcccagaacaggactcgaacctgcatgcctctcgacacacgcacctgaaacgtgactcgccaaattatatgcataaaaagaaaagccctcagatttttacattgatccgccgctagtaccattttcgcccaatttaaaagaaaaaccctctcagaatcactctaagagggtttattgaggttcctggcggattcgaaccgccgtacacggttttgcagaccgctgactaagccactcatccaaggaaccttgtttctcgtttgcggttgcaaaggtagtacaaattttgaaactaccaaactatccgcagcaatttttctttgtcttttttttcttagacgaacactctttccgcttcttctccatcatatcctttaattcacagccacttgcacaacttgcacaagggttatcattttctttcacacgacgaaaaaaaacataaataccatagaggatgcgggctacacacaatataatcagtaacccgacaacccattcttgccaattcataaaaacaatcctcctatctgataaacggcaaatgaaacaatccatgccaatgctgtggtatatcctgccgtaaaaatagcccacttccaactaccggactcttgcttgatggccaccaacgtggcaatgcacgggaagtagatcagcacaaacagcatatagctgaatgctgcaagcggagtgatcggaatccgttcagccagactgaccgcatcggcatcggcatcattggtataaagtacaccgagcgtacttactaccaactccttggcacccacaccggaaagaagaccgatactcagcttccaatcgaatcctaacggctcaagtacaggctccactgcctgacctatctgcccgatataagagttttcctgctgttccgcctgggtaggataagcattatgatccggataatagcccaaaaaccaaatgataatggaagcaatcataatgatacctcccatctttttgaggtattgcgcgcctttttcccatgtatgccggaagatagacttcatagtcggcatgcggtaaggtggaagttccatcacgaacggagtatcatctcccttcaccagaaaacggctgaacaaacgagccataacaaccgccaatgcgattccgataacataaattcccaataaaaccaaactgccattattaggaaagaaagcacccaccaataccaggtagataggcagacgggcactgcacgacatcaacggattgacaagcatggtgatcagacggctcttccggttctcaatggtacgtgaagccattattgcaggcacattacacccgaaacccattatcaaaggaataaacgacttaccgtgcaagcccatcttatgcatgattttatccataataaatgcggcacgagccatataacccgaatcttccatcaaggaaatgcagaaatacaatatcaggatgttgggcagaaatacaatcactcctccgactccaccaatgataccatcaatcatcatatccttcagcgggccctcggacatgttatcccgaatcaggttacccatcacctcgacaagccactcgatacccatcatcgggtactccccaattacaaacgtaccctcgaacatcagatacataaaaaggaagaaaatgggatatccccaaatgcgatgggtcacaatggagtcgagcaccttcgttgtctgttcctgctccagatgattgtcggtgaaagtttctttcaacgctccactgataaaaccatatttagcatctgtcaaagcagattcgctatcttcattcattgtctcctgtatacgccgggccgctttatcccgtttcttttccacctctgcggcattgggcagagtatgaatgaagcgttctatttcaggatcattctccagcaatttgatagccagataacgggtagaatatttatggcggataaattcgttctttgagatttcttctttcaccgcatcgatagccttctccaaatcggggccatgattgatatgaatatggcggaatactttgcccaccggttctttaccatgggtatagtcggcaggatgttcaccgtgatccttaaagttaggcagggtctgatgccaatccatgatttccttagccacttccggatggatatgcccttttttatcaataaagtcggcaccttcgtagagattgataacgacatggaaaagacggtctactccgatatttttcttgcaaacagtaggtaccatcggaacaccgaacaaattgcccagcaggcggtgatcaagggtattaccgctggcttccagttcatcgtacatattgagggctactaccatgcgtacattcatatcgataagctgggtagtaagatagagattacgctccaggttggaagaatcgaccacattaatgatcacatccggcgtttcatcaatgatgtggcggcggacataaatttcttcgggagtataagctgacagagagtaagtaccgggcaagtcgactatcttgaagtgataaccctggaaatcaaaatatccttctttggcatctacggtcacaccgctataattgcctacatgttcgtgggctcctgaagccagattgaaaagagaagtcttaccacagttcggattaccgaccagcgccacatttatcgtacgccgttttccaagggcaacccgcttcaaatcttcctcttttacgtcaatatcttcagtcaatccctgatgataagcagattcctgtgtttgtaacttagcctcctgctcgctgatgatctcgatcatatcagcctcctgtcgccgcagagagatttcataacccattattttgtatttgatcgggtctttcagtggagcattaagcaatacttctacggtttttcccttgataaaacccatctccacaatccgtttacggaagccgccgtgtcccagcactttgactatgactcccttctcacctgtttttaattcggacaatcgcatagtgtgtgtacctctaattttggcgcaaagataattcataactttgtggcatgcaaattatttagattgtttttaaataagagagaattcttatccatattgacaaaactattatctttgcaatatgatacaacatagaatagcacaatacatcgaaaaagagaagctcttttatctgaatgacaaggtattggtagcactaagcggcggagccgattctgtggctttgctacgattgttgctatcaatggggtacacctgtgaagctacccattgcaatttccatctgcgggataaagaatcggacagagatgaagcatttgtacgccggttgtgccatgaagcggaagtacctttacataccgtacattttgatacaattcaatatgccgccgacaaacacatttctatcgagatggctgcccgtgaattacgctacgagtggttcgaaacgctcaggaaacagcgtggagcagctgttatcgcagtagctcaccataaagacgacagcgtagagaccgtattactgaatctgatccggggtaccggcattaacggactgctcggaatccgtccaaagaacggaaacatcgtacgccctttgctttgcctgagccgcgatgaaataatcgcatacctgcaacgcatgaatcaggattacgtaacggacagtaccaatcttttggatgattatacccggaataaaattcgtttgaacctgttacctctgatgcaggaaatcaatccatcggttaaagagagcattatccgcacgactaactacctgaatgacacggcgactctatacaataaaggtatagaagaagcacggacacgcgtgctgacctccgaaggtatccggatagaggctttactgcaagaaccggtaccgggagccatcctcttcgaactgttgcatccgctcggtttcaacgccgcccaaatagaaagtatacaacaatcactcgacggacagccgggaaaagtcttcatcggtaaagggtggaaagtcataaaagacagggaattgctgctaattgaagaagatataaaggaggaagaagccaaaccacctttccgtctggttacggaagtatatgattatactcctgaatttataattcccaaagataaaaaaacagcttgctttgatgcagacaagatggatgcagcatggtgtataagaaaatggaaacaaggtgatgtgtttattccttttggaatgatcggcaaaaagcgtgtaagcgactatttgacggaccggaagttctccctgagtgacaagaagaaacaatgggtgttgtgttgcggagaacgaattgcctggttgataggagaacgaacggacaatcggtttaaagtaagcaacaacacaaagcgggtaatgattatccgaatctcccccaaagatatcaactaaaaatcaactgattacatttaccaagcccttaccggcacatgtaaaagcatttactccggcatgtaaaagcatttaccccggcgtgtaaaggcatttaccccggtatgtaaaagcatttacctcggtgtgtaaatgatgactacatccgaagcgccacatgccctcactatagatgacgtaagctacacgtctgccgggcaaaccaaaaaacagagcctcgcgacactttctatcggataaattgtatctttgtaaatccaaatcttgaaagtagagataaaaacgaacggatgataaaataataactaactaaacatgattcattatgaaagggaaaaagaatcttttaattctattctcctgtgtgtttatgatcatcatcgcaggattattcgcttgcacacgcagcgctaaagaaattattccgtcttcggaatacgctccttacgtcaatgcctatacgggcggtgtcatttctcaatcttctcccatacggattgagttgacgcaggaccagccgatggtggacttaaacaatgaactaaaggataatccgttccgcttcactccttcgataaaagggaaggcctattgggtcagtaataatactgtcgagtttcttccggaagagggacaactgaaaccgggagaactgtatcaaggaacattccagctgggaaatttcgttgaagtggatagcaaattgaaatcattcgacttctccttccgggtacaggaaagcaatttcacattacatacagctccgcttgaaataaccgcctcttcacccgataaagtaactgtgaaaggagagatccgtttcagcgataaaacgactaaggagcaggtagaaaaaatgctttctgccagtggcgggctgtcttctccgacagtcaccgtagagtccacctccaatccgtcagcctatagcttcgtcatcggcaatatccaaagaaataaacaagactacgaacttgaaatcacagcagacggaaagtccgccggaattgaccggaagcaaagtgaaacaatcactattcctgccaaagacagtttccgcttcctttctgccgaacgcatcgaccaaccggaaaacggaatacaaatcgtcttctcagacccggtttcggatgctcaggatttaaaaggactgatcgaaataccggagatttcttcgtatatctttcaggtaacggataaccgtgtgaatgtttattttgaagccagtcagctcagcaagcttacactgaaaatacacgaaggcataaaaaacggccaaggaaaagcactgggaaactcacactctatctcttttggcgaactgagtctgaaacctcaggtagaaatagcctctgcaggtgccatcattcccgactcaaaaaaccttgtcattccgttccgggccgtcaacctgtatgcagtagatttgcgggttatccgcatctttgaaaacaatgtactgatgtttatgcaaaacaattcgctttcttcggccaatgaattaagaagatccggaagactggtttacaaaaaaacattgtttttaggcaaagattcatcaaaagaccttcataaatgggaaaactattctattgacctggcaggtctgatccatcaggaaccgggtgctatttatcgtgtcatcctttcgttcaaacaggagtattcggcctacccttgtggtggtgaaagcccgagaatgcaattttccgaggaaaccgaatctttgaccaaagtcacatccggcactcttccggaagaagatgaagcagtctgggacaaacccgaaacatattattatttcagcggaaatgaaaatgccgactggagtcagtaccgatgggatgaacgggacaacccttgtcacccgtcttattacatgacatctgaccggatagccacttgtaatgtgctggcttccaacatcggcatgattgtgaaacgcaattcaatgaataaactttggatagcagtaaacaacatcctggataccaaaccggtggaaaaagcccaagtcactgtttacaatttccagttacagcctgtaggtaaagcagtgacggattcggaaggtttcgccacaattgaaacgaaaggggtgcctttcatcgtagtagcggaatcagacaagcaaaaagcctacgtaaaagtagcagacggagaagaacagtccaccagccgctttgatgtgggcggcaaggacatccaaaaaggcttgaaaggatttgtgtacggtgaaagaggagtatggcgtccgggagacactctgcatatctcgtttattctggaagatcgtgccaaacgtatcccggacaaacatcctgtagcattggagctctataatccaagggggcaattttatagcaaacttatttcaaccaacggactgaatggattctatacattcaagataccgacgcaggcagaagacccaaccggactatggaatgcgtacataaaggtgggaggtactgcctttcacaaagcgcttcgggtagaaaccatcaagccgaaccgcctgaaaataaacctgaaattgccgggagaaatcctgaaagcttcagataaagaagtacaggcacacctttcgtcagcatggctgacaggagccactgcatcacgcctgaaggcaaaggtagaaatgtctttatcgaaagtcaacacccaattcaagaattatggaatttacattttcaataatccggctacggaattcacctcggtaagaaccgatgtattcagtggtacactggacgaaagtggcaatgccggattcatgctgaaacttcctacctcggaaaatgccccgggcatgcttcaagccaacatcacgactcaggtattcgagccgggtggagatgccagtatccaaactcagtctgtcccctactctcctttcccgtcatacgtaggtatcaacctgaaccaaccgcagggcagatatatcgaaacagataaagatcatgtgtttgatgtcattacagtcagtcccgacggaaaaccggtgaaccgttccgggctggaatacaaaatataccgcatcagttggagttggtggtgggaaaacgataacgaatcattcgaaacatacatcaacagcagctccatcagccccgtagctacaggacggctcaacacagtaggcggaaagggacaattcagcttcagagtgaattatccggattggggacggtatctggtttacgtgaaagaccgcgaaagcggacatgctacgggaggtaccatctatgtggactggcctgactggcggggacgttccaataagagtgacccgagtggtatcaagatgttatctttctccatcgacaaggactcctacgaaccgggagaaaccgtaacagccatattgccggcttccgcaggaggaagagcactggtaacacttgaaaacggttcatccgtaattcaacgggagtggattgaagtatcggggaaagaggacaccaaatatcagtttaaggtgactcccgaaatggctccgaatgtttatcttcatatcagcctgctgcaaccccatgcgcaaacggtaaacgacctccctatccgcatgtacggtataatgccggtattcgtaactgataagcaaacggttcttgagccgcaaatcaagatgccggaagtgcttcgtcccgaacaggcattcaacctgaccgtaagcgaaaggcacggtaaaccgatgacttatacgctcgctattgtagatgacgggatgcttgatttaaccaacttcaagacaccggatccctggaacagtttctatgcccgtgaggcactgggaatccgtacttgggatatgtatgacgatgtactgggagccacagcgggaagctatggatcgatgttcagcacaggcggtgatgaaaccctgaagccatcggaccagaaagcaaaccgcttcaagccggtagtgaaattcatcggtcctttcagtattgccaaaggaaaaagccgcactcaccagatcactttaccaatgtatgtaggttccgtacgtgccatggtagtggccggtcaggacggagcatacggaaatgtagaaaaaactgctcctgtacgcactccgttaatgattctttcgacactgccacgtgtactgagtatcggcgaagagattgaagttcctgttaacgtattcgcattggaaaacagtgtgaagaatgtaaacgtatccatacaggcttccggtgccggagtacaagtgaacggcagcaagcaacagacgcttactttcaaccaaaccggtgaccggcttatcttctttaaattaaagacaggtacgaaaaccgggaaagctaccatccatctggctgctaacggtaacggacaaagtaccaaagaaacaatcgagatagaggtacgtaatccgaatccggtagtcactttgcgtgagagtaaatgggtggaagccggaaagagtgaagagctccattaccagttaagtaacgattcggaaggaaacagtatacagttggaggtctcacgcatcccgtctgtcgacataagccgccgtttcgatttcctatacaattatcagcacaactgtacagagcaactgacttcaaaagcccttccgctgctgttcgtcagccagttcaaaacagtagacaacgaggaatcggaaaagataaaaaccaatgtacaggaagctatccgtcaactatacgggcgtcaacttcccaacggaggtttcgtctattggccgggagatgcctcggcaaacgaatggatcacctcttatgcaggtatgttcctggtattagcacaagaaaagggttatgcagtgaacagtaatgtattgaacaaatggaaacgcttccaaaaggcagcatcccagaattggcaacccgtcacacaagagcagaactggtggtattggcaggcagacctccagcaggctttccgcctttacacactggctatggcgggatcacctgaacatggagccatgaaccggatgaaagaattgccggcactctcgcaacaagccaaatggcgtttggcagccgcctatgcactcaacggcaaagagaaagcagccggtgaactggtattcagtgctaagacaaccgtagaaccttattcatcgaataactatgtatacggttcatccgatcgtgacgaagcaatgatacttgaaaccttactgctgatgaaccgccagcgtgaggccatggaacaagccaaaatcgtttcacacaacctggcacaagagacatggttcagcacacagtctactgccttttcattgatggcaatgggacgtttggcagaaaaactgtccggtacgctggactttaactggacgttgaatggcaaacagcaaccggctgtaaaatcagccaaagccatatacgaggcatcactccccacttcaccacatgaaggaaaagtaatcctgaaaaataacgggaaagggtctctaaacgcagatctgatcacacgtacccaattactgaacgacacattgccgccgatggccaataatctacgcctgaacgtaaggtatttagacaataacggctcgccgatagatacacgttctctgaatcagggtacggactttatggcagtggtaactgtagccaacatcagtggtacgacggattatacgaatctggcactgacacatatcattcctgccggctgggagatctttaatgaacgaatggcaggacagattacaacctctgctccttatagctatcaggatattcgcgatgaccggatactgacctactttaacttacagcagggacaagccaaaacatttaccgtccgcttacaggcgacctatgccggtgattttgttatgccggctatccagtgtgaagcgatgtatgatgctaatgcacaggcaaggacacaggccggaaggacgcaagtcatcaggtaaaactatcaaataaaacctgatgaaccgtattcttaaaccaaacaatcttcccccctccccacaagggagggggtggaagaaatatttcaaaagttggtggaagatttctctcttcctcctacttctcctatacttattttgtcttccccggcaattattcacctctccctattctactgtcttggtcgaccgtaatggggaacttctcggtgcccgtatcgccacggatggacaatggcgtttccctccgcgcgacaacacaccggaaaaagtagctacctgtctggttgaatttgaagaccgtcaattctaccgccattggggagtcaaccccttggcaataggcagagccgccctgcaaaatctcagacacaagcgaatcgtcagcgggggaagcactcttacgatgcaaacgattcggctggcacggaacaagccgcgtacattcaaggaaaaactgatcgagatgataggagccacccggctggagttccgttattccaagaagaagatattgtcactttatgtttcgcatgcccccttcggaggtaatgtagtgggactggatgctgctgcatggcgctatttcggacactcggcagaagaactgtcctgggcggaatcggctatgcttgccgtacttcccaactctcccgccatgatccacctttcgaaaagccggcaagcattacttgacaaacgaaaccgactgctgacacacctgcaccaaaaaggtattctcgatacttccacttatgaactggctatcagtgagccacttccccaggaacctttgcctcttccacagatagccccccatctgacagaccatttctatcagacccgaaatggagaatattccgtatcgaccatcgacaagggtatacaaactcagatagaaagtctggtagaacggtggaacagcgaattcaagcgaagtgatatccgaaatatggccatcctcgtaattgacattcgtaccaatcaggccattgcttattgcggcaatgtacacttcgacaagaaaaagagcggtaaccaggtagatgtaatccggtcaccacgcagcacaggaagcattctcaagccctttctttattatgcaatgctacaggaaggagagattcttcccaatactctgttaccggacgttccggtcaacattaatggctttactccacaaaacttcaaccagcaattcgaaggtgccgtaccggcttcggaagccatcgcacgttcgctcaacattccttcggtcacaatgttacaacggtatggagtacccaagttccacaattttctgaagcagatagggctgaccaccttaaaccgtccctcaggacactacggactttctttgattctgggaggagcggaagctaccctttgggatgtcacttcggcctatgccaatatgggacgcagcctcaacggactggtacagaccccttgtaccttattattatcggactccctctccgcccaccgatccccggccatcattcaacatccgccattccaacccggagcagtctggcagacatttgacgccatcaaagaagtaaaccgccccgaagagatagactggcgtaccattccttccatgcaaaccattgcctggaaaacgggtaccagttatggtttccgggatgcctgggcagtgggggtaactccaaaatatgccgtaggtgtatgggtcggaaatgctacgggtgaaggcaagcccggactggtaggagcccgtacagcggggcctgtcctgttcgatgtattcaatctgctcccctcctctccttggttcgagcggccacaaggtaaactggttgaagcagagatctgtcggcaatccggacatttgaaaggacggttttgtgaagaaacagataccctgtttattcttccggaaggcctcagaacggaagcctgcccctatcaccacccggtcaccctatcagcagatgaacggttccgtatctatgaaaactgtgctgacagtgaaccggttgcccgccaaaactggtttacccttccacccgtatgggagtggtattataaacagcatcatcctgagtatcatccgctcccccccttcaaacccggatgcggagaagaccgtttccagccgatgcagtttatctatcctccgatgggagcgcggatccatctgcctaaacagatggatggtaaccaaggacagctgaccgtcgaattggtccacagccatcccaacacaactgtctactggcatctggacgaaacctacctgatgcagacacaagacttccataaattctctctacgccctgctccgggaaagcactcgctgacagcagtagacgacgaaggaaatacaatttcaacaacgttctttgtggaatagcccccaaaatggtaactttgcgccatgaaacagattttgaaagaaaatggtggattaccagcttcgatactctggacactcgccattgttgcaggcatatcggtagccaacctttactataaccagcccttactgaacatgattcgccatgaactgggcgtttcggagtttaaaaccaatctgatcgccatggtgacacagatcggttatgcgctcggattattgtttatcgttcctttaggtgacttataccagcggaaacgtatcattcttaccagtttctccgtattgattctctcgttgctcgtcatcgcaatggctcccaacatccatatcattctttgtgcttcgcttctcacaggtatctgttcggtgatgccacaaatatttatcccgatagcctctcagttctcgcgtccggaaaacaagggacggaacgtagggatcgtagtttcgggattactgaccggcatcttggcttcacgagtggtcagcggatttataggagaactgtttggctggcgcgaaatgtattatatcgccgcaggtatgatgctgttatgtggcattgtggtcatgcgggtattgccggacatacgccctaactttcaggggaggtatagcgacttaatgaagtctttgtattcattattgaagcaatatcccgaacttcgcattttctctgtccgtgctgcacttgctttcggttcatttctggctatgtggtcgtgtctggcatttaagatgggaggtgccccattctatgccgacagccatgtcatcggtatgttagggttgtgtggcattgccggtgctttgtcagcttccctcgtaggaaagtatgtacggagagtcggggtcagacgattcaatttcatcggatgcggactgattttattggcttggttcctgctgtttgcaggggaaaactcttattggggtatagttgccggcatcattatcatcgatataggtatgcaatgtatccaattaagcaaccagacccgcatcttcgaactctgtccgagtgcttctaaccgcattaatacgatttttatgaccacttacttcataggtgcctctacggggacgtttctggcaggaacattctggcaggcattcggttggcatggagttgttggtacgggaatagcattgaccatcggttcactgctgattacttttttctcaaaacgataatccgaagtcacctaataattgttatatagacatgaagtacggagtaaacagacaagtattattaatcacagccggtatcgtttggataatagcgggggccaatctcctgcgtataggtattgtgacctggctcaatgactcacgacactggcacttcaaggtaggcgaagctacggtcgtcttcctattgttttttattctcgtcttccgaaagctctactataaacatacccgccggatcgaacaaaagaaaaaggaaaaaaattgccccttctctttttttgacgcaaagggctggattgtcatgtgcttcatgatagcgatgggaattaccattcgttcgctacatctgttacccgacacgttcatctcggttttctacaccggactctcactggcacttatgttcacagggatattatttatccgctattggtggtgcagaagacaggatatcttgcaaaattaagagttatgaaaacgaacctgaataaagaaatgaatgaagagtttatccgtttccaaagaaacgaaaaaaccgaaagcatcgtatacgaacggctggcctctattgaaaaagacgaatcgaaccgcagagtattacgcctgatttcagaagaagaaaaggcacattatgccacactgaagaagtatacaggaaccgatgtagcacccgaccggatgcgtatagccaaatactactggttggcacgggtcctgggtattacatttgcaattaagctgatggaatcgagcgaagagaacgcacatcatgattatgccaaatataccgattttccggatctccagcagttggccaaagaagaggaaatccacgaacagaaactaatcggactgatcaacgaagagcggcttgaatatatgggatcggtagtactcggcctaaatgatgccttggtagagtttaccggagcactggccggtttcactttggcattaagcgactccaggctgattgccctgaccggaagcatcaccggaatagcggcagctttatcaatggcttcgtccgaatacctctcgaccaaatcggaaggcggagaaaacaaacacccggtgaaagcagctatctatacgggaatcgcctatatcatcacggtggcggcactggttgctccgttcatcctgattgaaaacgtactgatagctttaggggtaatgttggccatggctttaatgatcatcgcattgttcaattactactattccgtggcacgcggagagagcttccgcaaaagatttaccgaaatggtggtactcagtttcagtgtagccggtatcagcttcctgataggttacgcactgaaaacatttacaggaatagatgcttgaaaataaaaaaggaaaagaagaatcatgaaaaaaatcccctcgccccttgtctcgttgatccccttgatcgtactggttgccctgctatttgccaccatacgcacatttggcagcgatgcactcagcggaggcagccaggtgtccctcctgaccacaacagctgtttgtgtactgatcggcatgggattctacaagataggatggaaagactttgaactggctattacgaacaatattaccggtgtatcttctgcactgattatcctcttaattattggcgccctgagtggtgcgtggatgatcagtggcgtagttccgacactgatttattacggcatacaaatcattcatcccagttttttcctgacctctacctgcattatttgcgcattggtatcggttatgaccggaagttcctggaccacgattgccaccatcgggatcgccctgatgggaatcgggaaagcacaaggttttgaagaaggatggatcgccggagctattatttcgggagcttacttcggagataaaatctcaccattatcggatactacgatattagccgcctcggttaccgacacccccctgttcaagcacatccgctatatgctgataaccactgtgccatcattaatcatcaccttgataatcttcactgtagccgggctgtcacacaatgccggaaatacagaacatatagcagagttctcggcagcactggcaggaaaattccacattacgctatggttgctgattgtaccgataggaacaggcatactgattgcccgtcgggtaccttccattatcaccttgttcttgtcggcagcattggcaggagtatttgcggtattcttccaacccgatctgttgcaagaaatatccggtgctcagaattccgaaggtattcagtccatctttaaaggattgatgatgaccctttatggaggaaccagcctacagacaagcaacgaagcgctcaccgaacttgtggccacccgcggcatggcgggcatgatgaatacggtatggcttatcatctgtgccatgtgcttcggaggagccatgactgccagcggaatgttgggaagtatcacttccgtatttgtccgcttcatgaaaaatacggttagcatggtggcttctacggtctgttcgggtatcttcctgaacctcgccacagccgaccaatatatcagcattatcctgaccggaaacatgttccgggatatatatgaaaagaaaggttatgaaagctgtctgctcagccggactacggaagattctgttacagtaacttccgtcttgataccatggaatacctgcggaatgacacaggccacgatattaagtgttccgacactggtttatcttccttattgcttcttcaacattatcagtccgttaatgagcattacgattgccgctatcggatataaaattgtgagacgcaagtgaacaatctgaaaagggagttgttcttggaataaacgaacaacagttttaaacctaaacaaaaaaaagttatgaaaaagtttattgcattagtagcattggtattagtaagtgcatcgaccatgatgtatgcacaagagtctaacagggaggtgcgtcgggcagaccgcaaggcacaaagagacgccgaaagagccagactgaaagccgaagaacaggctgccgaccaagtagcgtatcaacaagccgtacaagctatcaaagacaaacagtttgtattggaagccgaccaagtgattttcaaacgtggccagaccgctttcgtgtcgtcaaacactaactttgtgatgctgaatggacagagagcaactgtgcaggtggcattcaacactccgtaccccggccctaacggaattggtggtgtaactgtggatggaactacttcggacgtaaaagtgactaccgataaaagaggaaacgtaaactgtaacttcagcgtacagggtatcggtatctcggctcaggtatttatcacattgaccaacggtggaaataacgctactgtaaccattaacccgaacttcaactccaatacattaactctgagcggtaacctcgttccgctgagtcagtcggatgtatttaaaggccgttcatggtaataaaagtaacgagtggccctctactcgtaactaattcacataactccgttgcaaatcgcacaaaaagtgtacatttgcaacggagtttttttatggatagattatgagagaatatatcatcgcagataaccaggacatcacgaaagcaggaatgatgtttttgttaagcaagcagaaagaagtaagcctgttgctggaagccgacaataaaatagagttggttcagctattacgcattcatccgcaagcggtggttattttagattatacattgttcgatttttccggtgcggatgaactgattatccttcaggaacgattcaaagagtcggactggctcttgttctccgacgaattgagtatcggcttcctgaggcaggtcttgttcagcagccatgcgttcggagtagtgttgaaagataactccaaagaagaaattatgtcggctctgcaatgcgcatcacgcaaagaacgctttatctgcaatcacgtaagcaatctgctgttatcgggaagcggaaatacaaacactgcttcatccgtgcatactttcgtgccgcaggaagaccgcctgcttacaccgacagaaaaaataatcctgaaagaaatagctttgggaaaaacgaccaaagagatagccgcagagaagaatctgagcttccataccatcaacagtcaccgaaagaatatattccgtaaactgggagtgaacaatgtgcacgaggccatcaaatatgccatgcgggcaggcattgttgacttggcggaatattatatttgaaaaaacgaaagaaagattttcgggaggggcatcatcctatttcaccactcccgaaacaaattctggattcggcatcgtaaatcaccccgaactgtcccggagcaattccctgtaatttctcggaagagataatccggtaaccgtctgcatcctgtatcaagcgccctttgataaactccggtgtatgccggatcttaaacgtaacgtcctcctcgcctgtcgaatctttccacggattacttgtgataaagttgaagtctttcatcctgaattcgtatccgtactgtttatcagcatcgtacccatgtgagacgtaaataatgttatcctgaatatcctttttcacaacgaaccaagggcctccccccaatcccaacccctttcgctggccaatggtatgaaaccaatagccgcgatgggttccaatctttttacctgtttcgagttcgatcaccgccccttctttttcacccagaaagcgacggacgaaatcgttataatttatcttgcctaaaaaacaaattccctggctgtctttccggcgggcactgggcaacccggccttcaaagctatctcgcgaacttcatgcttcatcagtcctcctatcggaaacagtaactttgaaacttgcagataatcaatctgagccagaaaatcggtctggtcttttataggatctttagctgtacccaaccaagttttctcccccagttgcaaagtcgtagcataatgcccggttgccgtaagatcgaaatcttttcctacctgctgttcaaaacatccaaacttgatcagtttattgcacatcacatccggattcggtgtctgtcccttccgtatcttctcgatggcataagcagccacattatcccaatattcccgatgcaggtccacaacttccagttccaaaccgtaacgccgggctatggcagtagataactcgatatcctcttcggcggaacaatccatgtattccgctccgtccatccctatttttatgtaaaaaagtgtaggtttatatccctgctcacaaagcaagtgtaccacaaccgaactgtctactcctcctgataataatgctgctatatccattttttaaattttctctaatgcctgacgcaagtcatcaataatatcttcaatatgttccgtacctatcgaaagtcttaccgttccgggcttaattccctgctccgccaactcctgtgcattcagttgcgagtgtgtggtagtggccggatgaatcaccagcgacttcacatcggccacattggccagcaaagagaatatctgcagactatcaataaatttctgcgcttcctccgttcctccttttacctcaaaagtgaagatagaacctgctccatcagggaaataacgctgatagatagtatgatccggatgatcgggcagcgatggatgattaacagctgctaccttcggatggttcaccagaaaatcaataaccttcaaagcattggctacatgtcgttctacacgcaaagacaaagtctctaatccctgtaacagaataaaagcattgaacggactgatggcagcccccgtatcgcgcaacagtacggcacgtatacggacaatataggcagctgccccggcagcatctacaaaccgtacaccatgatagcttgcatcaggttcggtcagttgagggaatttaccggaagcgacccaatcaaatttaccggaatcgacaataacccctcccaacgaactgccgtgtccaccaatgaatttagtggcagaatgtattacgatatctgctccatgctcaatgggacggataaggtaaggcgtaccgaaagtattatccacaatcagcggaatccgatatttatgggcaatggcggctacggcatccatatcgataatattggaattggggtttcccagagtttcgataaatatcgcctttgtattttcacgaatagcccgttcgaaattaaaaaggtcggacggatctacaaaagtggttgttactccataagtaggcagagtatgtgccagcaagttgtatgtgcccccataaatggtcttggcagctacaatatggtcaccggaacgagtaatattctcgatagcatatgtcacggctgcggctccggaagcaacggcaagaccgcctactccaccctcgagaaccgctatacgctcttccaatactccctgagtggaattggtaagacgtccataaatattccccgggtcctgcaatccgaaacgtgcggcagcgtgggccgaatcccggaatacataggaagttgtctgataaataggtacggcacgtgcatcagttgccggatcgggagtctcttgtccaacatggagttgtaaagtctcaaaatgtaatttcttcgtttccatttgctatctatatttagagttcattgtcagtgtccaatttttatatgttgcaaagatagaagaatccgaccggggaagaaatcgcacattgaaggcatttttataccataatcgtggtagataaagaggttattaactacatttgcaggcgaataaaacattattgatatgaataaacttttatactgtttccttttatcattttctgtcatggctgtttcggcatgtaccgatgataaggaagagcagaatcttcccccggttcccgatttcaaccaaatgaccctgaaggaaaatttgcacagtgacggaggcgatgtataccgcacggatacttacgtattcaataacaataaattaacgacccacaccactgtacaggagttctacggacagagcctgacacacgaagtgactctttcctactccggcaacgaagtgacgttgacagatgaaaacgggaatacgggtacctatattttaggggatacgggatatgccaccgaatgcacttataaattgtccagccagatcagaaagtataaattcacatattccggcgaatatcttacccggatcgacgaaaaaatagacggtacgccttattcttctgtggaattggcatacgataacggaaatttaagccatatcatagccaatggccagcaaaccaattatcaggtgggaaatacgaagaacctgtatcagcttccctgcctgcaggtttgtgatatttaccccctgtccctccacaccgacgctatttatgccagactgttgggcacccagtcaaagtatctgattaccggaaacactccggaaggaaacgaggaggaatatacaaaatacacttatgaactggataaagacggcaaaccaaccggaatcatagcaaagactacctctacgggtactgtgatcgatataaacggtaatgcatacaatgaaacgaaaacagatacgagaaccatcaatatcaatattgaataagaagaacggctttgcctctgccctcacgaagtagtgaagtaatgccccatccaaacctacccaggcttcatatacagagggagaaaagtgacacttataatcccagaatactctttgtcacctgttccctacttcttggcaaagaacttactgaagaagaggatttgataatcaatggaattattccagtatttcccgttatgttcaccgggacgggtaataaaatcatgattgatcttgcgccccaacaaccggttatgaaagtctttgtttacattcagaaaaaaatcatcttcaccacaatcaataatcaaagcgagatcgccattctgaattttatcaagttgattgactaccgtatgttcatcccacacctttttattggaagccatttcacccaactgtttgttcatactccaattctgcggaaaagggcggatatcgacacctccactggtgcttcctgccgctccaaacacatctttatgacggatgccgagccacatagccccatgtcctcccatactgagtccggtgatggcacgccccttacggtcggcaatcgttttataattccggtcaatataactcactaactccgaagaaacaaatgtttcataccggtacgccggattcttggggctatcccagtaccaactgtctttcccgtcgggacatacaaaaataatacctttttcatccgcgatttccggtaagttcggttttatctgaatccaagtcttggcatggccgccataaccgtgcaacaaatagagcacgggacactccactgcctgttttccagaagcaacatcaggagtcactaccactacttgaacctccttattcatagaggggctcttcaccatcagcgtatccacttttgcagcgctaagaggtaaagcgagtaagagcagacaagccaaaataaagtttcttcttttcatttttaatctatgtttttagcgtttacctttgttaatcccccacttcgggaacaacaggattgaattccgcaaccggtttctcaaaagcttttccacagtggctgcaaatatattcccaatgattatctcccggcggaacacctgccagcatagaagcgatggcagcgctgatggctttcatccggtgctcctttttaagaacaaacctgatttgatccgaaccgcagaaaggacaaaacttctgttcttcaggaatcatctgattctgctgtaacaatcgcacggccgcttcgtaatcacaatcggccaccaaaacatctactccggagatgtcacggacataacctcgcaacaatgtcgacatattttcattatgtaacagagagtcgataccttcgttagcaagtgctccctgaatgatatgagcttgaacggcatcattacaagtaatcagctttatggttttcataatttatatttaaaacttccccacaaaaatagcagataaaaacgagaggcaaaaccttttttatataactttgcacagaattcacaaagtatatcgaaaccaggccaatgaaaaaaactgttttcttcctgtttcttttgggcttgctcacggcagccggtgcgcaaccaacgcacaaaatcaaggggactgtaattgacaaagccagccgtcaaccactggaatttatcaatgtactgatcttggggctgggacgtggagcggtgacagatgctgaagggcacttcaacatctaggaagtcccccccggtatttatcgccttcaggcatctgcggtaggatataaaacggtacttacccccgaatatattgtctccactaaagatcttaccatccaaatcgaaacggaagagaacctgaccgaactggaaggagtcacagtgaccgcctcccccttccggcgtgatctggaaagtcctgtcggactacgcatcatcggcctgcaggaaattgagaaaagtccgggggccaaccgggatatttcacgcatcgtacagtcatatccgggggttgctttctctccggcaggatacaggaacgacctgattgtccggggtggttctccatccgaaaaccgattctatctggacggagtggaaatacctaacattaatcatttcagtacacaaggggcatcgggtggtcccgtaggaatcatcaatgccgacttggtccgtgaagtgaatttctataccggagcctttcctgccgacaaaggcaattcactcagctcggtgcttgacttcaaattgcgtgacggcgacatggaacgcaattcactcaaggcgacactgggtgcctcggaggtatctttagcatctaacggacatcttggtaaaaagacttcctatctggtttcagtacggcagtcttacctccaattcctgttcgatatgctgggcctaccatttctgcctacatttacagatgcgcaattcaaattgaaaacccgtttcaatacgactaacgaactgactgtactggggcttggcggcatcgacaacatgaaactgaacacgaaactcgacggagaaaaagccgaatatatcctcagctatttacctaaaattcagcaggaaaccttcacactgggagcggtataccgtcattatgccggagcccatgtacaatctgttgttataagccacagttatctgaataaccgcaacaccaaatatctgaacaacgacgaaagtagtgcagaaaacctgtcattgaaattacgctcggtggaacaggagaccaagttccggatagaaaatgcctcgacgttcggaaactggaaagtaaatttgggagctaacctggactattcgcaatataccaataccactttccaacgggtttatatcgatggaggcaagaccttcgattatcatacctatttgggattttggcgctggggattattcggaaccattagttatgctacacccgacgaacggtttaccacctcactcggagtacggactgatgccaacaacttctcttccggcatgaagggaatgtccgatcagttgtctccccgcctgtcactctcctaccggctgacggatggagtctacttgagcgggaatgccggactctattatcagttgcctccttataccggattgggattcaaggataacaatggcaaactggtcaacaaatacctccgttacatgagagtcagtcaggaaagcatagggctgagttggcgtccacgcaataccttcgagttatctattgaaggtttctataaaaaatatgataaaataccattctctattgtcgacgggatacctctggcctgtaaaggaaacgattacggagtgatcgggaatgaagcattaagttctacctcacaaggaagggcatatggagcagaaatactgatgaaatggctgatagccaaaaagctgaatctgtcctcttcgttcacgttattcaaaagtgaataccgcaacaacaaagaatccgaatacatagcttccgcctgggacaaccgatacatattcaatatgagtggaacctataactttcctcacaactggagtctgggaatgaaggtcagttgcatcggcggagcaccctacacaccttacgatattgacaaatcctctctggtgacggcatggaatgcccaaggacgaccctattatgattacggccaatataacacaggacgcttgccggcctttggtcaactggatgtccgcgttgacaaaacattctatttgaaacgctgtatgctcggtttttacattgacctgcaaaatgtgacaaacagcaagttccgccagccggacatattgatgagtacgggagtcatcgaaaatccgtcggctccgatagccgaacaacgctataagatgaaatacatctctcaaaaaagcggaactttaatgcctacattaggaatcacatttgaatattaaacacatagacaactatattattaattacaaaaacttactaaaatgaaaaagagaattgtttttatcgcagcactgttatgtggaatgtgcttcacgactgcctcggcacaatttaaaatcggcggtaaaaaaatcaatgtaggcaaagtggtacaggcaggaagtgacgcagctaaggcaatcacgctgtcggatgccgacattgcagctatgagcaaagaatatatgcaatggatggatacccacaatccgctgacagctgctgacagtgagtatggcaaacgactggagaaactgaccggacacatcaaagaagtggacggactgaaagtaaatttcggcgtatacgaggttgtggatgtgaacgcttttgcatgtggtgacggcagtgtacgcatttgtgccggtctgatggacattatgacagacgatgaagtaatggctgtagtaggacacgaaatcggacacgtgattcatacagactcaaaagatgcaatgaagaatgcttatctccgttcggccgtaaaaaatgccgcaggagctgccagctcgactgtagctaaactgtcagattctgaactgggtgccatggcggaagcattggccggtgcgcaatactctcagaaacaggagacagaggcggacgactatggttttgaatttagcatcaaacataatatcgatccatacgcaatgtacaatgcattgaacaaattattggaattatcggccgaagccccgaaagaatccaaattccagaaaatgttctcttcacatccggatacagccaaacgcgtagcccgcgctaaagaaaaagctgacgaatacaccaagaataaataaacccggatacaacattttctgatcctgcataaggccggcccccacatccggagggtcggcctcaactttttttgaaaaaattcattaataatttcgatagattttgcatgagtccgtactttagtgtaatttgcggtcatgaaactattcacatctatatggaattcttaatcattattcttttactcgtactgaatggtatttttgccatgtacgagatcgccttagtatcttcaagtaaagcacgccttgaaaccctggtaagcaaaggaaataaatcagcacggggagtactgaaacaattggaagaacccgaaaaatttctttctaccatccaaattggtattacgctgatcggtatcatatcgggtgcttatggtggagtggccattgccgacgatgtagttccccttttcgctatgattccgggagccgaaccttatgcaaaagatctcgctatgattaccacagtagtcatcattacttatttgtcgctgatcatcggagagctggttcccaaatccattgctcttagtaatccggaacgctatgcaaccctgttaagccccgtcatgattctgctgactaaaatttcttatcctttcgtatggttactcagcatctctacccgcctgcttaataagctgattgggctgaaaagtgaagagcggctgatgacccaagaagaattgaaaatgattctgcatcaaagttcggaacagggagtcatcgacaaagaagaaaccgaaatgttgcgcgatgtattccggttttcggataaacgtgccaacgaactgatgacccatcgtcgcgacctgatcgttctgcatacgacagacagtaaagaaaaagtccttcagaccatcgaagataaacacttcagcaaatacctgctgatcgatgataatacagaagagatagcaggcgtcgtttctgtaaaagatattatcttaatggtaggcaccgaacaggagtttgatctgaaagaaatcacccgtccggcactatttataccggaaagtttgtacgcaaaaaaagttttagagctatttaagaagaacaaaaataagttcggagttgttgttaacgagtatggcagcacggagggcattattaccctgcacgacctgaccgaaagtatctttggagacattctggaagaggacgatactgaagaagaggaaatcgttcgcagacaggacggctctttgttggtagaagcttcgatgaacatcggggactttatggaagagatgggaattctctcctatgatgacatcgagtcggaagactttaccacattgggcggactggcgatgttcctgataggacgcattccaaaagccggagatatattcatttataaaaacctgcagttcgaagtagtggacatggaccgcgggagggtcgataagctgcttgtcataaagaaagaagaagagtaggaatagcactcactttttatattaatttaaagcacttaacaatgaaaaaagtaattatgttggcagccgttgttgctgcattggtatcctgccaatcaaaaggaacaaaagctgaagaagcagccgcagacagtttggcagtggttatggaacccactatggaagaaactcaggtttatgaaggtgtacttcccgctgctgacggtccgggtatccgctacgtgttaaccttgaacacactggcgaatgcggccgatacaacgtatacactggacgtcacttatctggatgccgaaggcaaaggtaaagacaaaaccttcacttctaaaggaaaaccggtgacagtggagaaaaccgtaaagaataaaaagaaaacggctcttaaactgaacccgagtgacggaagcgaacctgtttatttcgtaatcgctaatgatactacccttaccctggctgacgacagcctggaagtatctgccagcgacctgaattacaacatcattcgtgtaaaataacacagaagtagtttaaacccaaaacaaaagccacgctaacattacatagcgtggcttttctctttaattatagaaattactatttagtcagcttctcaaaatacggcaagcgctccagcgggacatctattgttattgttttcggacctttaaataccttccctcgatcatctctccatttacctttgggcagcatcaccgtacggcttgtcccgaaagtcagcatcggagcaaccaagtatttgtcacccaacataaactggtctttacaatcgataaatccttgatggggatactggtattccatgtgccgaacaataggttcacccgtttcggaagcatgctttgccaatcccagaatataatctcccatttgttgatgcaaatgggcatacttagcacaaatcgctacattttctttactcaggatgcgccagggagctacggagaattgcatcatcggcatcagggcgtgtacctgacaggagcgtacaatcaactcttcatcaaacttcttcacattcagaaaagcaccaaactggcctccgcctaccatgtccggacaagtataataatgtcccaataatcccgcggcagtcatatcgggaattagcaactgagtcgcacgccaggaataatccttatcgcccagcctctgtaccaatgcctgaccacccaacttccaggcagcacgcaattcattgtagggaaagctcaaacctatctcggcccatttctccataaaagtattcacatcggcctctttatcatgaaaagcatattctcctgtcatataagcaacgtctccaccatcaaatttaaatccgtcgataccatatttctcctgattggcttttaactgttccttcagatgattcatagcctccggattcgtggtgtcataacaggcactgtaaccattccaccaatggatgatggctgtacgtccattcttatctttcaataaatatccctttgcttccagttcacggaattcaggactgtccggcgatacataaggagcaacccacagcattactttgaatcccatcttgtgcagttcgtcggtcattcctttcgggtcaggaaatctttcggatttgaagtcaaagttaccataatatctctgccagttatcatctaccatgaatacgccttggggaaatccgttttctacggctttatgggcataattcataatgtcctcctgattctgatcatacatcagttcaatccatgtattatactgtggaagagaaaagaaagcaggttccggtatctgtcccgaaggtggaaagtgtttcgccgaagctgccagtaaagcttctttcagtgtattccccgcttttaccggttctatcttttccgaatccgaatagataatcaattgtccgtctttcacctcaaaacagaaagatttctcggcccatatatatcggccttcggaagaaagcatgaacggaactacctgattattcatattattgcgtgacatatcctgcatccgcaaatgatcaccaaacggcatctggttacctaaagctacgaatcctccccaccatctttcatttttcaagggttcgatcactgttttcattttttcctgtgccactgcgccaagcagtagtccgaatgttacgagcaatagtaaagtcgcttttcgtctcatgatagttagattaatattaaaaaaattctcaagtggcaaaaatagataaaaaggcagaattaatggtttaccggcaaagaattatttttccggtctatctctgcacggataggacccaaatcaatcttttcatagccaatactcaaaaaaagaaagttatttcattcttttattctattttttcctatctttatcagacagttacaaacataatcttaaaaaagatggaacaaacatttaaagcaagaaatcccaagatagggctttggctattcgctataggcatagtagcttgcattgtcatcagtttcataacaattcaggcaatatggataggcgctgcatgcttaggtccaggtgcgacaatctacttttcgcaagcaaccagtagatacatcgtcaaagaaaacggaatgctgcaaattgtgaacggcttccatcaaaaacgctctttcaatcatatcaccagtattacatatactccccatgccttgggtatacagaaaataaaaatcaaacatgccactggatttgtcatggtagacccggagtcacctcaggaactgataaaagccctgcaagaggtaaatcccggcatgacagtaaggaactttacctgaaacaagatatagcagaaaataagaataaccgtttaaccaagctataataagatgaaaacaacaaaaaaatggacgggatacttattcctatgcctgttttgtcttcatgtatctgcacaaaacaaagacagccttgtccaaaagttgagccaatacgcctgtctgatagaaaatttctcaaaacatattccacaggagaaagtttacctgcaattcgataataccagctattatcaaggtgatgatatctggtttaaatgttttctggtcacctccgatctatacccggccacaaacctgagtaaaactttatatgtcgaattattgaatcccggaggtgaaataatcgacaaacggatattaaaaatagagaacggtcaatgtcacggagatttcactttaaaccaaatacccttttattcgggcttttacgaggttcgtgcctatacgaaatacatgcttaactttggggaagatattattttttcaagacttctgccggtcttcgacaagccccaaacagaaggaaacttcgctgaaaaagagatgcggaaatattcaacaggaaattacccgatggagcgccccaaaccgacaaaaggcaaaaaagtaaatttaaagttcttccccgaaagtggaaacctgattcagggaatagagtcacaaatcgctttcgaagcgacagatgcctatggcaaccccataacattgagtggtactgttatcaacgacgaaaaacaggaaacagcccatttcaccgcaatccatgacggacggggagttttcaattacacacctacaggtgataaacaaaaagcagtcgtcgagtttaatggtaaaaaacaccagtttaatatgccggaagccctgccagcagggtatgcgctacatgttgataatctgtcatacacagacagtgtggaaattgctttgcaaaagaatcccaatactcccgccactctattgggattagcagttatcagcggaggaaagcttcacaagttttgtctgatcgacgttgaaggaaatgaaatcattcgcttcaaaatagataaaagcagattaacacctggagtctcccgtatcgcgttattcaatggtggcggagaagtcctgtccgaccgtttgatattcattcaccctcaaaaacgattatctataaaagcacggacagacaaagaaacatacaatccctatgaattagtaaatctggaatttaccttaaccggagctgaaatgcaaccggtacaaaacacatttgctttatccgtaagagatggcatgaatgaagtggaatcaggacgcaatatactaaccgacctcctattaatgtccgagataaaagggtatgtccgcaatcccggctattattttgaagcggaagacgacacacaccgcatggcaatcgatctgttattgaggatacagggttggcgccgctactcttggaagcaaatgaccggaattgaacctctcaacctcaaatatggtcccgaaagaggtatcgaaacacggggccaggttgtttctttcgtccggcaacttccaaaacccaacgtagaagtatcgtgctttttgaaaaaacggggagaaaatgaagaaaacagcagcttcatcgaggctattactaccgatagtttaggacgtttttcactgatatcggatatctatgggaaatgggacttgatattggcagtgacagtcaacagaaaaaagaaagattatcgtattctattagacagattgttcagccctccccccgcaaaatatcattatgccgacatgcaggtgaacatcgccaatacgaaaaaagaagaagatactattccggataaagaaacaaatgtcttgacagaagacgacatcgaaaccttctttgccgcctatacagattcactggctaaagcaggcaaccacgaaaagaactatcgattgaaagaggtgaccatcaaagctaaaaaaagaagtaaagaaaaagagatttacgacagtcgttcaaaatcaatagcttattatgacgtccattctgaactggacgacataaaggacagcggaaaattcatcggtgacgacatacacgaactgatgctgaatatgaataagaatttcagtcctatcccacaaaggaattatctatattacaaaagtaaaatgccgctcttcgttatcaattatgaatgtacccgacatactgagatggactataataaatacaaatatataaggcttgaagccatcaaatcgatttatattactgaaaacctttccactatttgccggtatgcagacccacggctttcacccttcgatgtatccgacttatatggttgcgccgtattgattgaaacctatccggaaggcaaaataccgacagaggcaggcaaaggtgtcagaaaaacatggcttgacggatatagtccggtcaaagagttctatcagccgaattactccgcacttcctcccgttcccgattatcgccgtactctttactggaatccctcagttagtacggacaaggacggcaaagcccacatccgcttctacaataatagcagatgccggaaactaaaaataaatgcagaaaccatcacggcggatgggctaatcggaatatacgagaattgattttcttatatacactgaaatctgtcttgtataagatagaaagattaaatttattctttggcccatctctgtacgcaggataatggggagcagagggtcagactttaagtttatatgccgggcataaatgaaggggttgcaaaaaacgatttttgcaaccccttcatttatgatacagtgatgttatttttatttctttgccagaaacttcttagtcaaccatcttctgactggttcatcatagaacttcaggcagagataagccagtaagatgtttccgaaaaatacaaccaatgccatcggccacgcctgtgaaaagctgagttctttactccatacccacgcataaaacagatacatgaaagggtagtgtactatatacaacgggtaagatatgtttcctaagaattcacagattttagatgactttttatctgttgtttttcccgaagcacccagatagacaagtaacggaaaaataatgatggcacatacagaatcataaataccattcatccacggaaattcactaccaccgatataaggcatggaaagcaaaacaataattgccagactgcatatccaaaaggcacctctaacctgaagcggtttaaaaacacgcgtcatcaacaatccgatagagaatgaaaacaataaacgcaggaaacctccgatcagattataatctgccattgaccatcccacacccaagtgaccataaccggaaaaattgaatatggcaaatgaagccagtccgattccggccaatacaaccagcaccgtgagagccttcgtagacaacttgcgaataaacaatgcatatagtatgtttccgatatactcaaaaaacaaagaccaactgggaccattcaaagggtacatctcaccgtttccacggacttcgggacctgcccccggcgcaacaggaatcaaaaatatccccataagcatagccaacattaccatcgaaatggaaacctgtgaaccatcccacttctcacaaccctgtatgcaaaacgtaatgctacccaaaacagctcccagaaccaccatcggatgcaaacgaattaatctgcgtttgaaaaagtcttttgttttcatcgttttccaacggtcatcataagcatagccgataacaaaccccgataagataaagaagaaatcgacagccagatatccgtgattaaatcgctggtccatgggacttgttgcaaaaccttcgaatatatggtaccatattaccatgagagcagcgacccctctcaatccgtcaagaagttcataatgaggttttgtgtctaaaaatgcagtagtagttcctttttgcatgataatttacaaatttgtttttttgttaacggttacataataatgcggcaaagttacgcaacttgaaaaacataaaatttgttctatggcaaaatattatcgtataaaaattatttttgggccctgagacgactaagtgtagaaagcttgatccccagatatgatgcgatatatcccaaattagcccgctggcacacttgaggaaactgctgcttaaactcttcgtaacgttctttggccggcaatgcaagccgttccttatgtgaacgctgcaaacgtctatattcattttgatggataatccgtccccagttagccagttcgatattggtttgaaaaagcctgttcaagtcagccagtgatattttgtatgcaacaacgtcttcaagtgtttctacaaattcttcactcaacttattataatataattcatccatgctaaagacaatccccccttcacaagaaaaagaagtagttatttcttctccgttcacaagccagaaagaacgggtcatccctttttctataaaataagcgaacttgcaaaatgtattttcctttatcaacaaatgttttttgggaaaacggcataaggtcacactctctttcaacacttgtattgtatcgtcagaaagcaggcacacagaatttatcttatctataacattcgtcataaagcttcggataattgaatatctataaaagttattcagactaagccttaaaatagaaacacataactttacaatctggacgtaaagtcggtgtttattccgtagaacattgattatcaatactttcttatggagagacaggctctcgaacctacatattcaagaaatatcataaaattgcaaatcattaataatcaagcactatttggagtacatagtaaatctaaatctttctgaatatcttttgctattccaaatattgggtgtatatttgggtgtagaatttcaaacacacccaattatgaatatcaaacgaaacatcatttttgcattggaaagccggaagaagaacggtgtgccaatcgtggagaacgtgcctatccgtatgcgtgtcatatacgcaagtcagcgcattgagtttacaacgggttaccgcattgatgtagccaagtgggatgctgacaagcagcgagtgaagaacgggtgtaccaacaaactaaagcaaagtgcatctgaaatcaatgccgatctgctgaaatactataccgaaattcaaaacgtgttcaaggaatttgaggtacaggaagccatgcccactacccaacagctaaaggacgcattcaacctgcggatgaaagatacaagtgaagaccaggaagacgtaaagataagtttttgggaggtattcgatgaatttgtaaaagaatgcggcaaccagaataactggactgaatccacatacgaaaagtttgcagccgttaaaaatcacctcaaggagttcaaggaagatttaacctttgaatatttcaatgaattcggactgaacgaatatgtcaatttcctgcgcgacaaaaaggatatgaggaacagtaccatcggtaaacaaatgggattcctcaaatggttcctgcggtggagcttcaagaaagactatcaccagaatatagcatacgatacgttcaaaccgaaattgaaaaccacccccaagaaggtaatcttcctgacatgggaagaactgaacagacttaaagactatcagatacccaaagacaaacagtatctggaacgtgtccgggatgttttcctgttctgttgctttaccagtctgcgttattcagatgttcgcaacctaaagagaagtgatgtcaagtccgaccatatagaagtcaccaccgttaaaacggcagatagtctgagtattgaactgaacaagtacagtaaagccatacttgaaaaatacaaggacatccattttgaaaaccacatggtattgcctgttatcagcaatcagaaaatgaatgattatctgaaagaactgggagaactggcagaaattaacgaacctatacgtgaaacctactataaagggaatgagcgcatagatgaagttaccccgaaatacgcattgctcagtactcatgcaggaagaagaacattcatctgtaatgcgctggctctaggtattccggcacaggttgtaatgaaatggacaggacacagtgattataaagccatgaagccctacattgacatagccgatgatattaaggctaatgcaatgaacaagtttaaccaactataaaagtatcagtctgtttcacagattatccattattagagttatctttgttaagtaatagttagtaatatggaaaataacaacgaacataatataaagaaaggtcattttgatgcctttgtccatgctgtcggttcggaaatagaacaggcacaagtccggctcattaccgcagccaatgcccagatgttgttccattactggaaaatgggcaattatatactgtaccaccaaaacctgcatggctggggtggtaaaattatcaagaagttggcacaggcaatcagattcaattatcctgaaaagaagggatattcggagcgtaatcttacttatatgtgccagtttgcccgtttatatccgttaaatgtacttcgtagttttattgaaacagattcaatactgtcagtccctaatattcaaaacattactaatgaagtccttaaactcaacagcgggcaatttacgcaggagcttactgcgcaaatacaatcagctgataatcaatctttagaaattacgcaggaggttcctgcgcaatttcagaatgtagaaaaaacagtagcaaccatctataaaataaaaatagaggatatagaagatttattcttggcgtcaccgattgcaagaataaattgggcaagccatatggtcatactcaataatccgctaccattaggtgtaaggtattggtatatgaaacaatctgtagaaatgggttggagcagtaatgtgctgaaaatgcagattgaaagtaatctgtatgacagacaaatcaagagtaacaaggtaaacaacttcactgccacacttccggcacctcaaagcgatcttgccaattatctgttaaaagacccgtatatctttgacttggcaggagcaaaggaaaaggctgacgaaagggatatagaagaacagttggtaaagcatgtaacccattacttgctggaaatgggtaacggctttgcttttgttgccagacaaaaacatttccagattggggacagtgactttttcgccgacctgattctatataatatcaagctccacgcctatgtcgtcgtggaattgaaagcaacgccattcaaaccggaatatgcagggcagttaaatttctatatcaatgttgtagatgataaactgaggggagaaaatgataacaagaccatcggtcttttgctgtgcaggggtaaggatgaggtcgtggcacaatatgccttggctggatatgaccagccgataggtatcagcgactatcaattgagcaaggcagtacccgaaaatctgaaatctgccctaccgagtatagaagaagtggaagaagaactgaccttattccttgacaaggacaagaacccataatataaagtatatggcaggaaagatacagacgatgattccccaatatggagaacttaacagaatatacagagactatatagataattacgctttttcttttgacaggcagaaattcatatcggatttctatcaggagtataatgacatgaaatcctttgaagccgctatccttgaactggtgcttgacaagcaaaaagagcaatacaccttgatactcaacagtctgaaaactgaaatagaaaagagcatacaggcttatgagatacgcccgttaagtgacagagccatagaacgtgcttgctatcagcacatggaaaggtattctcaggaaattgaagcccagctggatgttacaagaagtctgagcaagccgctgaatgaagccaacaacaggtatgattccattggttacagggagcatacagccgaagaggaaaaacaggcagagaaagaatatgaacgctgcaaggctgaatatgacagggaaaaagccaaactgaacaaactctatgaccagcaaaaggctacaagaacagaggcattccaatatatgaagaactgttgtgcggacatataccgtcaaagctgcctttttctggatatattgaagaaatacattcctgacggaaagcaagagaataaatcaagcgagccaatcagtcagcaggaaacgacagaagaacaacaggaatatttcagcatgaaattactttcgctcattcatgaggtgtgcaaaggagaacagttcgaagaaatttccgcaccagatttctatgccaatatgaatcttcacccctgcaactgtaagctgaaaataaaaccgagagagaaaatacgtgtatgctatctgatattcctgatgagcgagaaactctccaaacaggacagggacaaatggaaagacagaatactgaaactgctggatattgacgacagctactacaaatccaagtacaaggagcctgtttcagatttccccagtgacagcaaccaaaatttcgccaaggaaatggaacatatattcagataatccgtgatatatcctgatactttacgaaagttccacttttaccactcaaaataatttttgagtggtatttttgttttctgatattcaataagatacaatgatattcagtttgtaccgtccccatccttaccactcataaccctacctaattttgcatcgttcgagaacagaaataacagccagtgcgcagggctgattgtttaacgactaaatagattggacgatgacaaatatccaagaattattatcaaaacccgtctggcaaatgacaggcgaagaattcatattcctgagtaagcacgcttcaggtcaggccgaagcattgccgcaacccgttacagacacggaaaagaagtatgtgtacggaatactcggtatagccaaactgttcgggtgcagtctgcccactgccaaccgcataaagaaaagcggtaagatagacaaggcgattacccagatagggcgcaagattatagttgatgcagaactggctcttgaacttgccggaaagaaaacaggaggacggaaataatgggaggtatgcttatggactatatgagagaaataaaggaaatatctgcagaacaggcgataatcctttggcaagcctcacgtctgagcctatcgaaaatctatgagaaagcacctgagattttaaaagtgcaaggttcggtcattggcacactgggcaatttcagtgcatccataggcaaagccaaaagtaaaaagactttcaatgtgtcggctattgtagccgcctcattgaaaaacggtacggtactacggtatgtggcagaacttccggagaacaaaaggaaagtcctttatgtggacacggaacaaagccattatcactgcctgaaagtcatgaaacgtattttacggctggccggtcttcctgatgacagggacaatgaacatctggagtttctcgctttgaggaaatacacgcccgaacagcgcatcaggattgtcgaacaggctatctataatacaccggacatagggcttgtaatcatagacggcatccgtgatatggtatatgacatcaacagtccgggagaatcgacacgtatcatatccaagttgatgcagtggacggatgacaggcaaatacacatccatacgatactccaccagaacaaaggcgatgaaaacgcaagagggcatatcggtacggagctgaacaacaaggcggaaaccgttcttctcgtggaaaaggacaagagcaacggggatataagcaatgtttcggccatgcacatacgtgcaatggatttcgagcctttcgctttccgtatcaacgacaatgcattgcctgaactcatagaggggtacagacccgaagcgaagaaacccggaagaccggaagaggaaaagttcgacccttacaggcatattaccgaacaacagcaccgcatagcactagaagcggctttcggactgaaagaggaatacggctacaaggatctggaaaccgccttaatcaagtcttatatgtcagtaggtgtaaaactgaaccatcaaaaggcggtatcacttatcaccatgctccggaacaaacggatgatagtacaggagaacggcaggaaatacacgttcaagccagactttcactattagaccgtctaacctgtaatcacttcactttattcggcaggtctatatattaaggataaagcgaagcgattgcagagaatgtaaaaccgcttcactttattaccgtatcctatatatacgaaaataaagtgaagtgattatacagaccgtacttcataaaaaggtacgggcgaaaagagaaataaatattccaaccattattcaaacactcatcttattatggatatacaaacagcaaaacaaatcaggatagcggattttctgtacagtttgggacattctcccgtcaagcagcaaggtatcaacctgtggtataaatccccgttacgggaagagacagagccctcgttcaaaataaataccgaacgcaaccaatggtatgattttgcaattggtaaaggtggaaatatcattgcactggcacaggaactctactattccgactatgtaccttatcttctacagaaaatcgaggaacagactccgcacatccgtcccgtatctttctcttttggcaagcagtcattttccgaaccgagttttcaggagttggacattgtacagctgacttctcctgccctgcttgcctatctacaggaaagagggataaacacggcactggcgaaaagagaatgtaaggaagcccgtttcacccacaacggcaaacgttatttcgccattgcttttccgaacatatcgggtggatatgaaatccgcaaccgatatttcaagggatgtatcgcaccaaaagaaatatcccatatcagacagtcaggaaagccaaggagtgcatgttacgtttttgagggatttatggattacctttcctttctgaccttaagactggaaagctgtccgcaatcacccgacttcgacagacaggattacatagttcttaattccgtagccaatgttcccaaggcactctatccgttgggaagctatgagcgcatccactgtttctttgacaatgaccgtgcaggaatggaagcaatacagcaaatcagaaaggagtatgatgctacccggtatatacgtgacgcctcgcaaatctacagtggatgtaaagatctgaacgaatatttacagaaacgaatagccgataggaaagagcaagcgcaatctgtcaaaaagaggaatgatacactatccaagaaaccgaaaggcttccggttatagcccactataactacacgcttcgctttcgtagttgtgggctctcccgaggggattagggctttgccctaatgacccactcagggcgtttcacccctgagaaccccgagcaaagagtgaccctctctttgcaatctccgcttatgggttacccctaagaacccctctgcgaaagcgagcaaagtaaatcaattgtaaacaaaggaaagaagctatggcaacaaaatcaagcatacatatcaagccttgcaacatcgcatcgagcgaggcacacaaccgaaggactgccgagtatatgcgtaatatcggggagtccagaatctatgtcgttcccgaactttccaccgataacgaacagtggataaatcccgacttcggcactcccgaactgcgaactcattatgacaatatcaagcaaatggtcaaggaaaagaccggacgtgccatgcaggaaaaggaaagggaacgcaagggaaagaatggaaagattatcaaggtggcgggatgctcacccatccgtgaaggagtattgcttatcagaccggacaccacactggctgatgtacgcaaattcggtgaagagtgccaaagacgctggggcatcactccgctacagattttcctgcataaagacgaagggcattggctgaacggtcagccggaagcagaagacaaggagagcttccaagtcggtaacagatggttcaaaccaaattatcatgctcatgtcgtattcgactggatgaaccatgaaactggaaagagccgaaagctcaatgacgaggatatggcaaccatgcagacccttgcttccgatattctcctgatggaacgtggacaggcaaaagctgtcacaggtaaagagcatctggaacgaaatgatttcatcattgagaagcagaaagccgaactgcaacgtatagaggaaaccaagcgacacaaggaacaacaagtaagccttgccgaacaggaactcaaacaggtaaaagcagagatacgcacggacaaactaaagaaaacagccaccaatgctgctaccgccatagcaagcggtgtaggttctcttttcggaagcggtaagctgaaagaactggaacatcacatcgagcagctacatcaggaaattaccaaacgggacaaagctactgatgaattaaaaattcagatacaacaaatacaggaacagcatagcagacaaattcgtaatcttcaaagaatacataatcaagaacttgaagccaaagacaaggaaatatcacgattgagcaccttgcttgaaaaagcccacaaatggtttcccatgttcaaagagatgttgagaatggaaaaattatgcgctgttatcgggtttaccaaagacatgatagaaaacctcttgacaaagaaagaatccatacaatgtagtggcaaaatttattccgaagaacacaggtggaaatttgacatcaagaatgatatttttagggttgagaaacatccgatggatagtggtaagcttatgctgaccataaaccgacaacccatagtacaatggtttaaggaacaatgggaaaagttacagcagaatctacgtaactcggtgcagagagagcaaaaatccagaggatttagaatatagaatagcctattattaataaaatcaagtatctatgcatccaaacagattgtttttattacagaatcaaaatcctaagaatttataaaaaatgaagcctaaagaagttttggaaaaatggatagattgctttaacaaagcagatgcttatcatatagcagagctgtatgctactaatgcagtaaatcatcaagtcgcaaacgaaccaataattggtaaagaatcaatctacaaaatgtttgtgaatgaatttgccactgctaaaatggtttgtatggtggaaaatatttttgaagatggcgaatgggctatcatggaatggaaagactctcttggacttcgtggatgcggattttttcatgtaaaagataacaaaatcgtctttcaaagagggtattgggataaactttcattcttgaagcaacacaatcttccaattgaataagtactatcagaatacggactgggaaattgaaatacccagtccgagttatataatgaattttacttgttaaactatttaaagtcagttggataacaaaccatacctttcacattctcagtagctccaggtattaattcagccaccatgcaatattcatgagagacttcgaaaggaaattcaattcctaaatcgatagccttgcgatagccaaatcgaggataatactctttatgccccaatacgactgctgtgccgtaacccaaaagtgctgccctctgatgggcttactgaatcaacatcccccccccaattcccttacgctggaattccggcaagactgccaatggagctacactcagggatgtgacagactgggtgtcactatctatctttacttctgtaagtaagatataccagacaatttgtttttctgtcattttcttgttcttatctaattgttaggctcattgttgttatacattgtttaattatagataaatcgtgaatatccttctctcttaaatcgtagcccgaatggaatacttgttgcccttttgcagaaatgcaagggatgcttctgccttcaaagactgctgttccaaaatagtccggttgaaattcataccagcctccatccaagtcggcttgtttggaagtgccgtccgcattcaagacaaaaggatggatatcaatatagcctaattctttgctatacagttccacacgggtgggcaaccaatttgtttcaatttgatatcctctctcctgcaaaagatcaaggagttggtctgtataattggcatcaaaatcaatgtcaatatctctatgcaagcgggtttgctgtccgtacaagacatccactccccagcctccatccaaccaaaactgcatgtccaggctttccaacaagtccaaaacttgaaataactctgtaatcgtagtgtgttctttctttgtcatataataattctttaataaataatactatgcgtaattatccaactgcttgattgaagaaataaaatttgcacccactccaatcagaaagataacccatccgctgatcataaagacggatgtgataccccatgcttccacccaatatcctgaagctacgatacccagcattgatggaaaggtactcaaactaaagatgagagaaaaagtccgtccaagcatgtccgaagccaagttctgctgaataatagcgatgaaaagcgcatggtaaatggaataggctatgcctcctgtaaatgttaggcaaacaaaacctataaatgcgcttgatggtaaataactggcgctaatcagatacaatcccaatatcacataagccgtatgcatcactaatgtttgcttgcttttcaaagccttacaggcaagtactaaaccgcccaacaatgcccctgagccccaacccatttccacaactcccatttgcaaaatgtttccgttgaaatgcagaagcgtcataaaaggaaataacgtaaaaacaggcataaggacaaaagtcaccagcgtaaagcatacgaataaaggcaaaatgcccattgtacgccgcaaggtatgccaacattccgtcagttcttttttgaaatctggaagaactttcgttttttgaagagaaggaatctggacacaaagtaaggtcagacaagcagcaacagctccgatcacatctatgagcagaatatactgtatgggaagccaaacaacgaggcttgcccctacaacgggagctatcacctcactgaaggattgaatggaatggtacaaacctgataccctgacaagatggtgcttgggaaccagtagagggatgcttgcctgtaaagcaggtgcatgaaacgtactgcctattgaacgacaagcagtcaatagataaaaaaaagaaaggtctttataacccttggttatcacaataaaaagacatagggtacagaacgcgatgaacaagtccgaataaaacatcgttttctttcgattccatctgtcaacatagaccccggcaaacaagcctaatacaaattgtggtaaaaatccagctaaaatagccagagataaagctgtcggggatttaaattcgttgctaatccaaaaaataatggagaagccaacaatcgtacttgttaaaatagatatgagttggcctattcctatcacggccaaagttgatttccaatgattcattgtgctaatatttcatgcgtttatagataagtactttcgtacattaagcaaaacgaaattctatccacacaaaaaacttgtattataatccactcctgacgttggaatacaataacaaatactttcaggacgatgtaaagtcctgaaaaatcaaagtgaatggatagataaatattagtcttttctcatcggattcttttaatatcgctactcttttattatgtagtggttgtattatcttaaataaaacaaaaacacccgactttacattcttgggtgcaaaactgggtgtttgttttgcaatctgctgattttcagcgtttgttgcggagagacagggattcgaaccccgggtacctcgcagtacaacggttttcaagaccgccgcaatcgaccactctgccacctctccaaaactacttttcaatagtgcttttctcttaaagcgctgcaaaggtacgaatcattttttaatctgcaaatttttccgcaaaaatatttggaaagagtcacggctctttcatttaacaaccgccttcctcccttgtcccccccacaaaaccttccattcgcacacagcgatgcggaagcagtgcttcgttgtttcttttttaagaaagaatccgaccggctattaccggagaagtgtgatatgcgcaactttccaaacatattatcaactcaaattaattccgccaacaggtaggaattattttttttaataatggatagaacttatctgataatagaatgaatttatcactattgttgtatgcgtttcgaaatactcgtttctcgttgtaatgcccttttatataatacataggcagaaaaggtattttagatagagtatataatttgtataggatgttactactttgatgatagatatttagaagaccttctattctcaaactatgtaacataggcctgttatgataagcggttagaataaccgtttcttgtttttttagtggagatagtaaagtataatctatattacagaattggcttagtataatatcgaatttattacctgagtatttgtaactttccgatagctttattttttgtttaaaaaagtttgaaggatgctctgactcacgcatgtatcccaaagtacaactatgaccttttgcgataaatcctttggcaagaaggttcgtcatagttgctactcctcccatataaggaggatctgcatcgaaagatatgataagaatgttcattgattcttttattgagattttgtgatgtatatattgagttaaacgattaattctatgtcgtataatcgggatgcagtgtttgagaacgtagaatttgtacagcctataattttttttgttgctccaaggcaatataaatctactacagcacctttcatgccttcaacatcatcccttacaagtggtagctgtgagaagatgattctgtccccatatctttttgtcatatcttttttgacactttcttcatctgatgataaatagaaacggcagtttgagtttattgttatttctcggtccattagcgaataaaatttttctattggattattttttattgaggcaagattgtctgtacgtctgatgtgtacaccaactacgttatcttcatattgttctgttatcagagaaattctctcttttaattcttgggtcggcttgaaaaaagttgctaaagatgatgttatttcataaggtgtaaatggattataagatgtcacgtaaatgtttggttttcctgttgtcaatttttcaaaattgtttctattgattgtgttgccattataatatgcatcaaaataaatcttttttaatatatcgggaatgtatagattctttttcctgccgggtttgagataaaactttcggagtggttttatttctatacagtctaatggttcaaaaagatcggtaaagtgtgcatagcattctttgcttttttcccagtaaatgtataattggacatctttgtgatatttctgatataggatgcctgacgtaatggcatttagccggttgcacaaaccggcagtagggattagagttattttcatttaatcttgttttttagactttttactaaaagggttaatctctcccgttcttccgcattaacacctttatataagaatgataaaataaagactcctgtacagcagctgacagttattataagtcgtaaaataccggacggcattatattgataatgattccgcccgtaaggaggcttatacccgctatagataaacatgggattagggttgtaataaagtaagaacgtggtggaatttggcagtttttccatgcaaaataaatacgtgtcccaccttcgcagatactccagatggcaatgcttatgagatacatagtataggggggagcaccaaagtgaaatgcggtataaatcagaggtagcggtagtatattgaggaatgtaatgattatactgatgcgctttatgttaccttgtgcggatatagaggtgtttaaaactaaagtaagctgttcgattagagttcttattagttgtaattgcgtgaagataacggtatattccggtacttgctttaaccaaagggatagaatgtagggggcttcgatgattacaggaagtgcgaagatagccgtcatcagaaaagtgaatttacatccggatagagctatctttgtggataaatcatgattggaggcacctgcgcttttgccaattaccgggtttaaggccttcagcatattgcctgagaataccgataattgacctgatatttgtcctgctatgccttgggctgcatttaatacggttccgaaaaacatgttcagtacgattcctaaaccatagttgcctatcatgcttgttgcgctattgccaaagctccatcccgcaaagcttgtcatttctttcatcatcgtcttgtcccagtatttcttgggtgcgatcgtgcattccatataatgtttgtggcaatatattcgcattatggtcagcgtaatcagtggtatgcatgccatcaaaacgccataaacaatcagtttgtctgagaaagtataaacaacgataagtgctactgataacttcagtaatgattcgatgattcctacgatggcatagtatttcatgttttcgtgggcattgagcactgcgtcataaggaacggacattaccgtaaacatggtgctgactattagactgccatatactacctttgcggcaaaaatccggtctgctggaatattcagaatgccgttgaagaaaaaatatccggcaatcagcagcgcaattcccgcagccaatgctataaagaaatgcagtaggatgctgatattgaatatacttttctgcttttccttatttccttccccttccgagtaggacataaatctctgcgtggctcccgccatcgccgcgttcaggaatcccagcatggctatggctccacctacgatattgaatataccgaaatcagctgctcccagtgaattcagaatcagtcgagtggtatatagcgagatgaacatcgtgatacccatcttggcataaagaaatcctgtattttttatgacacggttggcggtagaactcatagatcgttttatagcgtggcttattgtatcttatcgtttttttatttattgatatccttcatctcaccgcctccatctttcccactctctccacgaaccccaccggcatatccacatgggcgcagcccagcatatccagccttaccgccaccttacttttcccgttgatggtcaccagctcgccttccagtccggaaagggggcctttgatgacccgcacctgttcgccgggggcgaggggggaggagcacacttcgatggcttcttcggagtagtcgagcatgaagcggaaacgctccatctgctcgtcggggatgacggcgggggtactttgtccgcgcagcaccatgtagcggctgacggacgaaagggtcaacacttcggcacgttctgccgggtcgacgtgtacgaagatcatcatcgggatgactacacgctcgatctttttgcggcggtcgctccattgatggatttcttcctgcacgggcaggaaactttcgatgcccattgccgtcaggcggtcacgggttttcttttcgtgatagagacggacgtaggcggcaagccaggatttcatgtcggttggggagtatggtttgagaaagtgggagggtcgctcccggatacgctacgcggttacctgtcacagttgtctgcttgggtaaaccgaatcttacgtttgattttgctgcaaatatagatataaatttactaaatacaataaattgttcattaaaatagaaaaaataatgaatttttaatctttggatcgtacttttgtgagttttaataattaacatatatttcaaatttaatgattatggaaaaaaaactacaagttaaagaactcgaatgaattgcttagagagttgtccggacaggtgtttgccttggtgcgtgagcttcccaaaccgctctcgagggaggagatgcgggagatgaaacggttgtgccgcttcctgagtaacacggtgaaggatcaggagcggaagcgggaggtgagaaaataaattcgggtgttaaaaagagccgggaggcggacggtgaaagtggcgtgtgggtaggtgtggaggctttccgaagggactttaacggcggttttaacattcggaagtgtaaaaagtttgttgttcttttgcatcatggttcattgcagaggatgcagagtggcaagggttttgctttgtgcgcttggcggcggatcgggattaaaaacattaaaatttaatactcaatgaagaagagagagtttaaaatttcctttttcctccatgtgtgggaaaagaaagcggaagagatttcgttggaagagtttcataatgacctcaggggactccgctggaaggtgcttgccgagtcgtatcggcggtggatgcagacggggatggccgaggaagccaagaagctgaagggtgccctgaatgcagtggtggtagccggcaggtgccggggcggacatgcggcgaaccaggtgagccggctgagcggactggcactgttcgactttgaccactgtccggagaaactgtctgggatgaagaagaaggccaaggcgctgccttatgtggtggaggcctttgtcagtatctcgggtgagggcttgaagctgattgtgcgcatcgatgcggagaatgccgggcaatacgcggcggcttatcctgtcgtcgcccgtgagttggagcgcgtgttggggcatccttgcgatatgtcgtgccgtgatttaggacgggcatgttacgcttcgtatgatccggaggcgtatcataatcccgctgcagaggtgtttccgtggagggagcaggcggacggactgccgcaggcggaaggggagtatcctgcgcaggcggtggacggagctcgtccggcaggcgtcgctcccgaagcggggaatggctttatgcaggctttcctgaatgattttgatgtccggaatccgtttgcgacgggagggcgtcatgcgtttatgttgaagttgggacgttatgcccggtataaaggtttttcgccggaggaaatgcggctgttgcaaaaaacagtggttgagaaatacgcgcaggctgatttcggaagcggagagattgagaaaacgttattctctggttatcagtatgcttctgtcagaaaggcggacgctgtcggggaagaaaagggctcaaaggctcaaggctcactttatacccctcacggggaagaggagggggatgatttggaagatctcttgttcggaaaaagtgaagcttacagacgacaggcgccttactttcccgaagaggtgttcgagcatctgcccgaggtgcttgcggagggagtaaaggtggcgggcagctatcgggagcgtgacatgttgctgacggcgatggttgccaacatcagcgcttgtctgcccgaggtgcgtgttttgtatgatcaggtgtactactcgccgcacctgtattacatggtgattgcccatgccggaggcggaaagggggtggtgtcgcttgccggcatattgcccggagagattcaccggtattatgagaagcagaacgaggatatgcgtctggtgtatgataaggctttcttcgagtgggagatggagctgaaaaaggcgcaggcggagaagcgttcgccggacttttcgctgcgtcccaaagagcctgcccgtaaattgctgacactttcgcccaatgtgtcgaagagtttgctgatcagtgcattggaggagagtggcaagttagggtgctgcatcaacgctacggagctggacatggtgtcgggagctatccgcaatgagtacggaaagcatgatgacgtgtttcgggcggcttttcagcacgaggtggtttcggccgattttaaggtgaacgggcgccaggtggtagcccaccatccacgcttggcattgtgtttcgccggtactccgaatcagttggcgcgtttcataccttcgttggagagtggattgtacagccgttttctgatctataccggacagagtgattggtgttggcgttcggccgctccccgggcagggggtgaagatcatcaatcggtgtttgcccgtctgagtcacaggctgttggagttacacctgtttttgcttcagtctcccacggaggtcacgtttacggctgcgcaatgggaggagcatacgtctcgtttctcctctcacctgtccgaggtggtgaacgagcgggatgattcgcccggggcgatcgtgctgcgtcacggattgatggcaagtcggatagcgggtgtgctcactgctctccgcaagggggagtgtgcctgggcgatgccgcagtatgtgtgttcggacgaagatttccatactgccatgctgatgacggatgtgctcctggagcatagcttgctgctgtctaccagtgtgcagaagagtgaaacgaactccaaacctctgaagccttatttcaggttacggccggtattacaatctttttcaggaacttttaccttcgccgagatggtagaaaaggcggtgaaaatgggaattccccagtccactgccaagaggctttttaaaaagactgtagacttggaactcgttgtgaaagaggatggaaaatatcgtaagactcaccgtaagtgggcgtaatgatgcttgtagagtgagccttgagcctttgaaccttctcaaaaaggatagggggaaggcgaatgtatgaaaaaactcttaagccttttctgaaaagacttaagagtttctactaaaagacttggatgtttcgggggaaacgtctaagtctttttcacgtttttcaccacagaggacacagggttcacagaggaaaaatttattttccccggaatcggtttttaaattaaaactctgtgtcctctgcgtcctctgtggtgagctcaaggttctcccaagtaatgcactatcagcccgacttcgcgcttgaggaagctgtggcggtatttgttgtaattgacttcggacagtgcccgggtcagggcagtgtttttacgcatccagcggtagagtttctgcagggcgagcaccgggtcgaggcccgggcagtaaagttgtgcaagttcggctttggtgtacgagcggataatgaaatcggcttcggttgtgtcttcttcttttctttggttcatggttttgattatctgattgttatctaccgtaaatatacgaaaaaatacccggaatgcagcgtgtttttatactcttttttcgtcaaactttgtcatcggcgctctttccttgtcattggcgcatcgaggttgtcgtatctttgaaatgtgattgaaaaacagatgtttaactctaaaaagaaagtacgattatgagtaaagaagttacgtattcggtagtggcgcgcaagaacatgcagaagaaggatgatcccgccaagtattatgcccaggcacaggcgagtggcgatgtgggtctggacgagatctcgacccgggtggaaaaggcctgtacggtgcactcggcggatgtggtggcggtgctgaaggcgctggaggatgaaatggtagacgggctgtcgaggggagagattgtacggctgggcaatatcggcacgtttcaggtgggtctgagaagcaagggagctgaaaagccggaggatttcaaagcggcgaatattagcaaggcgagagtgaacttccgtccggggcctgtgctggcggatgcgatgaagacactcagcttcagtaaggtgagcacccgggcggcgcaaaagggcgacggcgacggggggattgtggatgacccgacggcatgattttcaccacagtttttcaccacagaggacgcagaggacacagaggaggaattaaaactctgtgttgctctgtggtgaaaccgagtggtgaaacagaagtttggaaaattaaaaactctgtgtcctctgtgtactctgtggtgaaatctgtggtgtaaacgtaaaacaacttaatatagcaaagcaacgatgaagaagttacaaagaatcttggaatgggtgatcgcgttcctgatgtttctcagcgggaggaatgtcgaaaagtgaaggagggggtatgaggaaaatcgacttaatcgtgattcattgctccgcaacgagggaagaccggtgctttacggagttcgatctggatgtctgccatcgcaggcgcggcttcaacgggccggggtatcacttctatatccgcaaggacgggcggattgtgtccactcgtccggtagagaaaataggggcgcatgccaaagggcacaatgcgacgagtatcggtatctgttatgaaggagggttggatgcgaggggacgtcccaaggatacccggacggagtggcaggtgcattcgatgcgggtgttggtgaagactctgctaaaacagtatcccggcagccgtgtgtgtggccaccgggatctgagtccggacttgaacgccaatggggagatcgagcccgaggaatggataaagcagtgtccgtgttttaatgtgattgatgataaaaaaattacattgatgttttaaaatggaaattgaaccgctataaaagttaatttaattaactcttatggcggtttggttttcatggcataagtgtaacaaataattaattcttcatattttataaaatcatagagatgtctaagtgtgtttttggccgtaaccatatccatagccgtactttttgccgtacccgtagtagcgtccgtattttccgtatccatagtaataaccgtatttccgttttttcatgtcgagcccgttgatgacggtacacaggttcggaagtttgttgcccagacgaagatcctcgagcagggtatagtcggctttatgcgtatagtcggcacggcatacgtaaacggagaggtcggctacccgtgcgatgatctgtgtgtcggtgaccagcccgatgggggcggtgtcgagtatcacgtagtcgaagtgccttttcagaatatcaatggcctgcaccaaagcctggcgtgccagcagctcggtggggttgggcggaactgttccaccggggaggatactcaggttgggtgatatctccgagggctgcaccatagacagcaggtcggtatgctgcggattggccaggtattgagtgattcctttctctttgtgcgaaagggagaatactttgttcagtcccggcttgcggatgtcgagtcccacgatgactactttcttgccgagcagcgagaggctgatggcaaggttggtggctacgaatgtttttccttcgccgctgatggtggaggtgaccaggaccactttgttctcttcgcccagcatgaattgcaggttggtgcggatgccccggaaggtttccgccatcaggtcgttttcgttttcgcggacggcgatgcttccctgcttcccttctccctcttccgccagggggatgtctccgatgatagggacggaagtcagtttctccacgtccgcccgtccttctatgcggaactggagcaggcccatgacgtagatgacggctacggggatgcctatccccatcaggagcgcgatcatgtagaccgtctttgtcttgggtgagacgggaccgttgtcggccatggcttcgtctacgattttggcattattggcagtggcagccagcgcgatggagttttcttcccgtttctggagcagcatcaggtagagtccggctttgatttcctgctggcgcgagatgctgacaagctggcgttcctgggcgggagcattgctgatgcggcggttgaacttgttggcctgccggtcgaggtcggctttggtgatcagcaaacctttctgaacgctgtggatggtggtcaggatgttttcgcgcatggcacggatgctggtatccagattcacgatcaccgggttggtttccgaagaattgagcagcaggcggttgcgttggagcaccatttcgttatactggctgataagggtggacagggactggtcggtcaggccgacgttgacgggcaacacggtgttgagcttgtccggagcggagatatattcggctaagtagcgtaccaggttgagctgggtgccgttctccacccgttgtttctcgtaggcggagttttcgctgacggccagttgggcatcgcttgccaggtccgtcagtccggcatcccgtttgaagttttccaattccttttcggtactgaacagctcgtcgttgatgatgcggatgcgtccggcgatgaacttttccgttttctccgccgcctcgttcttgtcgttgttggtgttccggttgtagacttcgatcagccggttgatgaagtcctcgccacggcgcttgttggtgttctttaaagagacgatgacgatagaggtggttttggacgttggttctacactgagtgctcccgcatagcctttggctgtccacaggggattgttgacaacggcggtgagcgtctgcggttctttgacggtgacggagtcgtgggcaagcgtaaacgtgaacgtgcctgcgggagtagtgagcagggccggcagcttggagaactttttactgtaggagctctctccgatggtggctttcacgtcgagccggttgccgggcgacagggtgagttcgaacacggccggcgctgctaacttgtccgcttcttgcggagtgagtcccaccagtaccggcgaatttttataaagttccgtttcgttgaaactgcctttggctgtataggtggtgtagaggttcagttcgctgaccacatgcttgaccagcgttttggaacgtagtatttcaatctcgttgtcgatgttcgacaccgagctgaccagacccaggccttcgagcgcggtgaggtttcctccgctgttgcctcctttcttatcgtccttgatgactacggaagccgagatgttgtagaccggagtggtctgccggaggtataaccatgctcccgcaaggcagaggatgatcgaagtcacgaaccagggccaccggatgatgtagcggaacagcatggcgtggaagtctattttctcttctttctcttcgtatagatcgtcgtataagtcttctttcattttcggggtttctttatttggcgattgtaatgattaaactggcaagcgacacaagcgtgcctaccacagagaaccagatggtggtgctggtgctgatgtcggctgtttttgccttggtcttattgggcgtgacatacaggatgtcgttctgttgcaggtagtagtagggcgattggacgatatctgcccggttcatgtccagcgtgatgatgtgctggtgtccgtcggcatcctcgcggatcaggcggacgttgtcgcgcaatccgtacacggtcatgtcgcctgccatggcaagggcttcgaagaggttgaccttttcgttgctgatggtgaaagttccgggagcgtttacttcgccgatgacagagatcttataattggccatacggacggtgacgatgggcgattctttgatatagtcgcttaacttccctttgatcagtgtttccgcctcgcttttggtcagcccgccgatgtgcagggtgcccagtatcgggaattcgatattgccccggttgtctaccaggtattgctggagtgccggctggctggtcaggctgctctgcgcggcgctgacgggagtcgctacggtgaggttgaacggttcagccagttcggggtcggtgcaggacacgacgatggtgagcagatccttcggcatgatgcgtgcatcataaagcttggcttccgcaacggcacgctgcgcctctcccgagtcttgcaaataaggcactttcttgtaggactggcaggaagccagcaggatacaggttaacgtaaaaaaaagtagtctttttgtcatttatcttaattttagaatattactatatggggtggttcaccacagattacgcagattaacacggattaacagattatccccttgatatttaaggtttaagattctgtgttaatctgtgtaatccgtggtgaactctttgttttaataagcttctttttctccttctaacgcatttcttacagttttatatattatatataaatcgagcatgaaggtccagtgctctatataccagatgtcccgttgcacgcggccttccatttgccacagctcgtgggtttctccacgaaagccggtgacttgcgcccagccggtgacacccggcttcacaaaatggcggaccatgtatttgttgatcagttgtgagtattgctccgtatgtttcagcatgtgagggcgggggcccactaccgacatgtcgcccaacagtacgttgatgaactgcggcagttcgtcgatgctgcttttacgcagaaagttgccgaatcgggttttacgcggatcgtgcaaggtggcttgcagggtgtcgctctgtgcgtttactttcatggaacggaacttgtagcaccagaactcgcgtccgtcttctccgcttcgcttctgcttgaagaagatggggcccggtgaggtgattttgatggtcagtccgacgatgatatagataacggggaagagcgtgcacaggaacagcagggagaaaacgatatcgaacgtacgcttcctgaagcggttttcggtgaaactgagaggctcctgacggatgcagagtacgggcacgttgcccagaagctcgaagtacatccggcgtttaagataactgcgtacgttggggacgctgaagaagcgtatcaggtgattctcacaataatcgatgatggggagtatctcctcgctgcgggcggatggcaggcagcaatagacttgttcgattcctccccgtttcagataatccacaatcttgccgggttgtcccaggtatttcactttttcgggaaagcgactgccgggctggtcgtcgaaataaccgatgacacgaaatccggaagtgacatcgtccgtcatttgatgatacagttcgatgatattgctgttgctgcccacgagaatgatgctgcgggagtttcctccatgcttgcggtagcatttcaggagtctgcgaaacaacagacggtagcagactaacagcgtggtgaacgtgagatagaatatcaggaagaaacgtgcggagaggataccgaagtttccaaaggtgagggcgcaggagaagaatagggcgtgtccggcgctgttgcgtatggcgcgccatacaatttgttcgggacgtactacgcggcaatgcagtatgacgcccgatgacatgttgctaaccagatagcataagttgagtaatactaaaacctgtggaagtgagtgggtaaatggatctgcaaagaatttacttcctaagagtgcgtacagagatagaaagataccattcaagagaattaaatctccggcgaatactatcctttttataactttattaaaccgcaatacctgtttcataatgtatctataggagtgtatgtaatagttgtcagtgcttgatccactatcatcttgctgtgtgcattacaatttgttcccttacttattaggtaatagaatgcagaataacgaaaagatataaaatatggcttggagaggttaactaaacataaaagagggggtagcttatataactacgatgtaaaattatcgcaatttggtaactcctgtttgagtaattacatcaaacaggaattatgactaatctttctattaaatgaataaattatttcaaactgatatttaaactgattattatccactttattagaaaagaaattatcattttgtttgtgatatttcaatttttatctctacttttgcagcgataaaacaaacaaatctgttctattacctaataagtaagggatcgctttgttctattacctaataagtaagagaaccatttatatcactcttcttcttccttctttagtctcacggcagcaattacttttttattcgcattactcagtgttttattatcaaaagaagccaggtagatgtatgtcaccttttccgaagcatgccccatgccggcactgattactgaaaccggaacccccttttgcagggctgtggtggcccagctatggcgtgctacataagaagtgagcggagtcttcagcttaagcatttcagatatccggttgagtcgcttgttatacaccctcagcgcactccggtattgcttatgcccttcttcaccggctgcgctgatgaccggcagcagatagatggagtctgcacagagtgccgcatatttcctcagaatcgctttggcacagctttctatgatgaccgtaagttgctgacccgttttctgacggaagtaaaccagtgttttccctctcacgtccgttttgcggaggtgcaccaggtcgacaaatgggatgccacgcagatagaagctcagcaagaagaggtcgcgggcaaaatcgagcttactgttcttacccagatcggcctccagcagacgggagatgatggaaggcgaaatagcccgtttggcggtaggttcgttgccgatgaaaacattctcgaataactcccgcgtattgagtgaagccaggttttgctcgatggcctgattgcaaatggaacgtaacatgcgcatatagagtgagatcgtattatgccttttcccactcaaaagcaaatactgttcgtactccttgatgctctcgggagtgatttcttcaaaagtaagcgaatcttttcctgcaaacttctgataactgtgcagggtgtaaatgtaagtgttggctgtactgtaacgaccacctaacttagccttcttggctaaagatttaatgaacttttcaatttccattttcttgttttttttagtgtgttcaacaacaatgattctaataaaaaagattttgagcggtaaggcagaaaatttgcaggaaattagtaaaaaatcaatagccataaagtatagacgaatgaaagtgtcataaatacccaaatggtccgatgaaaaaggagagtaaaaaagtgtcccgaatttggatgaatagccgttctttcgtggtgtattaatcaattaaaaacatgaaattatggtaatagcttatttgagagtaagtacggaaaaacagtttttagctaatcagaaagaagagattttgcgatttgcagagaaaaatggattatcgatcgacaagtggtacacagagactatcagtggaagcgtaagcacaaaagacaggaaattatcagagttactgaaaaggatgcacccgggggatacactgattgtaacggagatttcgaggctgagccgtacattgctcgagattatgactatcctgaatttctgtatcaagaagcaggtggtgctttatagcaccaaagaaggctatgtgtttcaggacgacatcaacagtaaggtgctgggatttgcattcgggctgatggcggaaatcgaaaggaaccttatttcgatgcgtaccaaagaagcacttgcacgtagaaaacaggaaggaatgactttaggcagaagaaagggggatacgcctaaaattaaattgctgagtgccaacaagcgggtactaaccagagaacttgacaaaggaactacttactcggaactggcggaaaaaatgggggtgtccagaacaacattattccggttcatgaaaacgatgtattagtgaatgatgaatgattagggaagccatgattcaccacagattacacggattctcacagattaataatttattttactgagagttaaattaaaatatctgtgttaatctgtgtaatctgtggtgaatatgagttcattcactgtttatcatttatcgttcatcgtcgatgatcgtttatgaaggcttttcagttcgaaggagagcatgacccggaagaaaccgatgatcaggaaggtgaatgccagcatgtatataacgtaaagtgcacccacggccggttgccagagtatgatcagcgaacaaatgatggcaaggataccgaagcccatgtaccatccccactcacgggttccataacgtttcaggtccatggaatagcctgtggcagagaaaccgcggaacatcatccagaaagcgacaatgaacggtatgacttccatgctgagcaatgggtaggctaccaggtaaatacctaagatcaggtcgataatacctcctgcgagataccatccccaggacgagatgcttcgccggttgctgatggaaaagatgatttcgataataccactgatcagcatggagatgctgaagataacgctgagggcaatgtaactgcttcccggtgcaaacagcaggcagagagctacgatgatgtacagaatacctaagataagagataaccaccagttttttactgcgtgttccatctcgtcgaataaagttttcatatcaattctatttttagattattgtcccacgtgaacaaagtaagcgtaccgattgtttagaatatagtaaataaaacttagagataacaattatggcaacaacaaatttcaaaggacaaccggtaaagctgattggcgaatttatacaggttggaaaggtggctcccgattttgagctggtgaaaagtgatttatcttctttctcactaaaagatttgaaaggtaaaaatatagttctgaatattttcccaagtatggataccggtgtctgtgctacttcggtgcgtaaattcaataagatggcagcgggattaaaggacacggtggtattggccatttcgaaagacttgccgttcgctcagggacgtttctgcacgacggaaggcattgaaaacgtgattccattgtccgatttccgtttttcggactttgacgaaagctatggagtgagaatggccgacggaccgcttgccggattgctggcacgtgcggtggtggtgatcggaaaagacgggaaagtggcttatacggaacttgttccggagattactcaggaacctgattatgaaaaggcactggctgccgtgaagtaatctgtgtaggagaagatttaggaaaaaataaagtccgtgttcactccaaggaggtgggaacacggactttttcatgtggaattgttacttctttttggtcatatcgaagtcgaactgtactttagaagtcggtacaaccacatctgccagtttaatctcgtcggcattgagcttcatcttcaactgattgtttttgtaagcgaagctgcctttttccggagaagaaatggttacggttacggtctgacccttttcaccttctgtagcagagggcaactggaggatcagcggtttcggttcgaatgcaaggtagatactgtctttctctctattgagagccggcttgtaacctactttgtatttcacgtcaccgagagctttgataatggcttctgctttgtctttgtcaccgataatagagatgataaggtcgtcaaccggcaatttgtcgaagaaaacggtatcattctttattgtcgcattgacatcctgtcccttgggagtttcaccttcaccggcattctctctgcctgcaagcggagtaacttgggtgatcagtacttttccgttataagtgcctgccacgtcaccggtcgatggaggagggagcggagagttgtcatcgttgtcacaagaagacaaggttaccactgaaaaagcaatcgcaaaagcataaaaaagcttggatagattaaattcttttttcattttcttaaacattaaatttgttacataaatcagtcgttcatcaaccaactgtaaggcctaggatttgttttttgatgaattgttgattaactggtttggtgtacgtacaataagtaaatgcagggaatataaagatactgcatggaagaggaaaaaaaagaaagatttttttgagggagggatgaaggcggagttttaccacggagtaccacagagtctcacggagtaatacggaataatacagagtaatagagagtagagagtgatacagagtaatacaaagttcttagagttcactaccattcgttatcgatagattaagttcactctgtgttgctctgtgttactctgtggtgaatgctgattcttgctgtggaggcactatttctttttcttcattcctttgtagataaggaagccgacgatgaagactccgatggcaatgaagcaatagcccagttcgtggctgtattcggtaactttggcaagcagttgctcttcgctttcaatgccggggacggtggacagatagtatccgatggcggcaaggatggtgttccataatcctgcgcctaaggtggtgtagataaggaaggtgtgcaatttcatgcgggcaagtccggcagggatggaaatcagttggcggactgcagggatcagacggccgatgaaagtggacagcgctccgtgcttgtcaaagtattcttcggcatgttgcactttggcttcatcgatcaggcacatgtgcccgaaacggctgttggcgaatttatagacgatgggacgtcccagccagcgggccagatagtaattgatgatagcgccgatattggctcctatggtggcaaaaagcactaccaggtagatgttcaactcttcgttgactgctgctttgtaagctgccggaggaactaccacttcggatggaaaaggaataaaagaactttcaatggccattaagagtgtaatggtccagtaattgaggtggtctaaacaccactgaatgaaggctacagattccatttgtttaatttagattgaatttaatatagttttggtttttggattatttttcgtcttttaagaaatcatccagttcacggagcatctgttctccatccgttcccatttccaggatcatattccgaagcgattcgagattgatggagttgccacacatctcgttgtatttcttgaatccttcgtggtcctgaagtacaaggcatacagaagccagttgttcgcagactttgggatattcgggatcttcctccaatacttgctcgaagcaaaaacgggcattctcgagcatacggtattcgaggctgtaattaccgatttccatccatgtatcggcttcgggggcataacggagagccagtgcccattctgcacgggcctgatcgaagttgccctcttccatgtaaatgcgtccctcaagcagatagggctctgcatcctgtggagccagctctttggccagccggcaaaggcggtgggcttctgccgagtcatccagatgggaggcacagaccgctttgtttgaatagatatcggacagtaacggagaagagccgttgccgctttcttcgattgcctgaagggccaggcggtagctctcggcggcttctgcccagttctcctgatgggcataagccaatccgatgaacatgtaggtgaattcgggagagagcgttttatattccagtgctttctgatactctgcgatggccccttcgatattttcaaggtgaaacaggctgtgtgctttgatgatatgggcttcgccgaattcttcatcggctgcgatagcgaagtcgcaggattctacggccttatcaaaatctttggtggcgaactgacatttggccagtcccacccagtaagccgggttgtatgggttcttgtcgatcagcttgttgtagaagaaggtggctttttctatatgtgccgctccggctgctccataacaatcggcggtggctgccagaaaatcttcgtcgtccttatacagttctatcccccgcgtaagccactgtatgcctttttccggatagcctaaatcggtatacaggtagacaacatcgaccaggatgccgagttcgtttttctcttcctcttctatgctgtcgagtatttggtcggcatcgtccagcttgccttcgttcagcaacagttcggctaagagtagtttgacgttggcggagtaggtgtcggtgataaggtccgccacttcccgggctttccggggttggttgagatccagaaacaggtaagcttgttctaccatgaggtcggtatgccccggatgaagtccgagtccgtacgaaatgacttcctgggcttccttgaacctgcgttcggaggcgtattgatcggcaatatcggccaattggtcaccatccatatagggagactggttgttggcctttaatgtttcgtattgcacgatcatattatgtaattcccgctctctttcggacggggagttctttctacccaatttaattagtaattatacagttaataatgatttgattcggagggagaaggtgtgtcataactctttttaccacggaggacacagagttcacagaggaaaaatttattttccccggaaccggtttttaaattaaaactctgtgtcctctgtggtgagtttcgacacatactctcttgccaaaaagctatttattgatttttccccaggtatctttcagtcccacggtgcggttgaataccagatgaccgggcgtagaatctttgtctacattgaaatagccgatacgttggaattgcagataggaaagtacgggcaggtcggccacgtatttttctatgtagcaacgggtcagagtggtcagtgagtccgggttgatcatttccttcatggcttcgagagcatcacaacctttcgcctcacggatggcagccatctcgtcacgcgggttttctactttccaaaggcggtcgtacaagcgtacttctgccggcaggcagtgtgcgcagctgacccaatggagcgtacctttcactttgcggttggcatccggcataccgcttttggtattcgggtcatattcgcagtagacttcggtcaccgtaccgttttcatctttcttgcagcctgtacatttcacgatgtaagcgttcttcaggcgcacttcctgtcccggagtcatgcggaaatattttttcggcgcgtcttccatgaagtcttcgcgctccatccacagctcgcggctgaactcgatggtatgacttccggcagtgggatcttcggggttgttaatggcatccagttcctcaacttgtccttcgggatagttggtaatgatcagtttcaccggattgagcacggcagatacacgcgtggcacgggcattcaggtcttcgcgtacagcgctttcgagcagggcgaaatcattgagggcgtcgtaagtggtgtagccgattttgtcgatgaacttacggatggattcgggagagtagccgcgacggcggaatccgcagagggtcggcatacggggatcgtcccaatcgttgaccagaccttctttgacgaggataagcaggttacgcttactcatcagggtataattgaggttcagtttgttgaactctgtctggcgggggcggttgtcgtccagatccttgccttctttcaaccagtcgatgaacagatcgtaaagagggcggtgaggtacgaactcgagcgtacagagtgagtgggtgactccttcgaaatagtcgctctgaccgtgtgcgaagtcgtacatcggataggctttccattgggttccggtgcgatggtgtgccacatgcagaatgcggtacatgatcgggtcgcggaagtgcatattggggctggccatgtcgattttggcacgaagcaccatggagccttccttggcttcatcgctattcatcttttcgaacagggcaaggctctcttcgatcggacggttgcggtacggactctcgacaccgggttgggtgggagttcctttttgttgggcaatctgttctgaggtctgttcgtctacgtaggctttgccttctttaatcagagtgacggcaaagtcccataactgctggaaataatccgaggcataatatacgttgccccactggaagcctaaccattggatgtcttcctgtatggcttctacatattccatatcctctttcgtcgggttagtgtcgtcgaaacgaaggttgcacacaccaccatgtgcagcagcgatgccgaagtcgaggcaaatagctttggcgtgcccgatgtgcaggtaaccgttgggttccggcgggaaacgtgtttgtactcttcctccgttctttcctgctttcaaatcattttctactgcctgttcaatgaaattaaggcttttcttttcgcttgcctcttcgttttttatatctgtcatatctgtcattattataaaagctcgtagctaataagttgctgcaaaagtaggatattttttttgtataaccttatttcacgggtatatatccactcttttttataatatcctgtccctcgggagaaagaataaactggagcaggggagcgatttgtgctttgttctttacgtcataataataatagagggggcggacaatgggatatgtcttgttggtggcgttctctacggtggggccggcatagtgttctccgtcatatgaaacggacagggttttgatgcgtggagacacataggcgagtcctacgtaaccaatggcacctttggtctggctgaccgactggataatggctccggtggcaggcatggaaaggctgctgctcatataatttttgtttttgaggacgctctccttaaagaattcgtaggtaccggaagaggtttcgcgggagtaaaccactattttgcggtcatcgcctcccacctgtttccagttggttatcttgccgcggaagatgtcttcaagttgccggcgggtgagttgcttcaccggattggacgggtggacaacaacggcaagcgcgtcataggcaacgatcacttcgtctatgtcccgtttggcagctttggctttcatcttttcgctgaacttaatggggcgtgaagccatggcgatgtcagtggtattatccaacagggcggagatacccactcctgtaccacctccggtgacggtgacacgggcatcgggttcccggttcatgaagcgttcggctgtttgctgggctacgggcaatacggtgtcactgcctttaatgcgttgggcattggcattcagtgctgcgagggagagggcggcgaataagatagttctaactttcatatgattgagtttttatttctttcaccacagattacacagattttcacagaacttttaatcttacataccaacaggattaattattgatctgtgaaaatctgtgtaatctgtggtggattctatatttatgtgcaaataaagcaatagtgtattacattcttgtttcaaaacgttcgatattccgccttgtaacataaatgtaacgcctttgaaacacttccttcaaacggtattcacacatccttaatacttactctgtttctttgcatcatgaaaatcagatggtatgaaaaaggtttttgaaaggattatagaaggaattttgacctgtagcggatttgtaacgagtattacgatcctgctgattgtgcttttcctttttacagaggcattcgggctgttcagcagtaaggttatcgaagaagggtatgtgctggcactgaacaaagataacaaggtcagtgaactgacaccgatgcagattaaagatgtttttgatgaagagatcaccaactggaaagaactgggaggtgaagatctgccgatccgggtgttccgtctggaagacatcacgcattactactcggaagaagaactgggagaggcatacgaaaatgccggggcaaagattatggagttgattcagaagacgcccgggatcgtagcttttattcctcagaagtttgtaactcagccggatgcggtgcattttataaaggataataccatttccgtgaaagatgtgtttgccggagcggaatggtttcccacggcaacaccggcacccctgttcggctttctgccgctgattaccggtacgctttgggtgagcctgtttgccatattgattgctttgccgttcgggctgtcggtgtcgatctatatgtccgaggtcgccaacccgaaagtgcgcggttggctgaagccggtcatcgagttgttgagtggtattccttcggttgtatatggttttttcgggttgatcgtgattgtgcctctgattcagaaggtattcgatttgccggtaggtgagagtggactcgccggaagcatagtgcttaccatcatggcattgcccacgattataacggtgactgaagacgcgatgcgtaattgtccccgtgcgatgcgtgaagcgagtctggcactcggggcttcacagtggcagaccatttataaagtggtgatcccttattctatttcaggcattacttcgggggtggtgctcggcatcggacgtgccatcggcgagacgatggctgttttgatggtaaccggaaatgcggccgtgattccgactacgattctcgaacctttgcgtacgatccccgccaccattgcggccgaacttggagaggcaccggcagggggaccacactatcaggctcttttccttttaggagtcgtgctgttcttcattacattaatcatcaactttagcgtggagtatatttcatctaagggcgtaaaacgtagtaagtaatatggaaatactgaataatacaaaagctaaaaggcgttcgcagggcatcgctttcggcatattccggttgctgagtttatgcattgtgctgattctgtttgcgattttagggttcatcatttacaagggtatcggtgtcatcagttgggattttctcacatcggcacctaccgacgggatgacgggaggaggtatctggccggctatcgtgggcacattctatctgatgacaggcagtgcgctctttgcatttccggtgggagtgatgagtggaatttacatgaacgagtatgcgccgaaaggaaaactggtgaggtttatccgtgtgatgaccaataacctgagcggcattccgtcgattgttttcggtctctttggtatggctttgttcgttaattatatggacttcggagatagtattctggccggttcattgacattgggcctgctttgtgtacctttggtgatccgtaccacggaagaggcgctgaaggcgataccggacagcatgcgtgagggaagccgtgcattgggagctaccaagttacagaccatctggcacgtgattctgcctatggggatgccgaatatcataaccggactgatccttgccttgggacgtgtgtcgggagaaacggccccgatcctgttcacgtgtgcggcatattttcttccgcagttgccgacaagcattttagaccagtgtatggcgctgccctatcatttgtatgtgatatcgaccagtggcacggatatggaggcacagttgcctttggcttacgggacggctttggtattgattgcgatcatactcctggtgaacctgctggccaatgctttacggaagtattttgaaaagaaagtaaaaatgaattagtgacggagtacaacaaaaaatatggatacaacagtgaaaattgatgcgcgtgacgtgaatttctggtatggtgacttccatgcactgaagggaatcagtatgcagattgaagaaaaatctgtagtcgcgtttataggtccttccggatgtggaaaatctacttttctgcgtcttttcaatcgtatgaacgatttgatccctgccattcgcctgacgggggaaatccgtatagatggtgaaaatatctatgacaaaggagtgcaggtagacgaacttcgtaaaaacgtaggcatggtgttccagcgtcctaacccttttccgaaaagcatttttgagaatgtagcttacggattgagggtgaacggagtgaaagataatgcttttatccggcagcgggtggaggagaccctgaagggtgccgccctttgggatgaagtgaaggacaaactgaaggaatcggcttatgctttatccggcggacaacagcaacgcctttgtatcgcccgtgcgatggctgtatctccttcggtgctgctgatggacgagccggcttcggcactcgaccctatttcgacggcaaaggtggaagaattgattcatgaactgaaagaacggtataccattgtgattgtgacgcacaacatgcagcaggccgcccgtgtcagtgataagacggcatttttctatatggggcagatggtggagtttggcgatacaaagaagatctttacgaatccggagaaagaagccacccagaattatattaccggacgattcgggtaacctgtgatttttcggcgcagatcgtcgaaacatggttttatattgtatatttgcttaataattaatttaatacatagagtatggtgaagtttatagaatcagaacttgttctgctgaaaaaggaaatagacgagatgtggacattggtttacaatcagctggatagagcaggagaggctgtactgacactggataaggaactggctcagcaggtaattgtccgtgagcgcagagtgaatgcttttgagttgaagatagacagtgatgtggaggatgtgattgccttgtataatccggtcgctatcgatcttcgctttgtgttggctatgttgaaaatcaatacgaatctggaacgtttgggcgactttgccgagggaatcgcacgttttgtgctgaaaagtgaggagcctattctggatggagacttactgaaacgccttcgtctggaagagatgcagagacaggtgctttctatgctcgaggtggccaaacgtgcgctgaacgaagaaagtctcgaactggcaacttccgtattcgctaaagataatttattggacgagattaatgccgaagctacagcgatattggctgattatatcagagagcatcccgaaagcacgctgtcttgcctgaatctggtaggggtattccgtaagctggagcgttctggcgaccatataacgaatattgccgaggaaattgtctttttcatagatgctaaagtcttgaagcatagtggcaaggtggaagagcattatcccgataaataataaatcgcaaatttttaaacaaaaattagtgctacttaaaaaaatgtcatatatttgtctcctgtaacggttcggttacaggagttttttttgaaatgataataaatccaaagaaaaatcaaaaagatgttatatgacatgtttttatatttggttcataacgagaaaagcacctatatttgcaccgttatcctgaaaacaatctttttaccttaaaaaaaaactaatacctattgaaaactgaaaagcggggctttgtgaaaagccccgcttttttatgtttattcactcactctctcccattttctttgtatctttgacccccgttgatgcgcgtatgcatctttttgaatggtaaatcctaatattaaaaatagaactatgttttccggaatcgtagaagagtacgctaccgttgtagcactggtgaaagaccaggagaatatacatttcacactgaagtgttcgtttgtaaacgagttgaagatagatcagagtatctcgcacaatggagtctgtctgactgtggtcagcatggcggaagatacctatacagtgactgccatgaaagagacactggaccgctcgaacctccggttgctgaaggtgggggacaaggtgaacgtggaacgcagtatgatgatgaacggacgtctggacggacacattgtgcagggacatgtggatcagactgccgaatgtatcggtataaaagatgcggacggaagttggtatttcacatttaaatatgctttcgacaaggaaatggctaaacgtggctacatcaccgtagataagggatcggtaacggtgaacggtgtcagtctgacggtatgcaatccgacggacgatactttccaggtagcgattattccatatacttacgagcataccaatttccatacttttgaggtaggcagtattgtgaaccttgaatttgacatcatcggcaagtacatcagccggatgattcaatataaatagcaggaccaggtatgaacgactttctgcaattggtaaatgcccggcagagtgacagggcctatgataaatcacgtcctgtggaaccggataagctggaacgtatcctcgaggcaggacgtttggcaccttccgcatgcaatgcgcaaccctggaagtttgtggtagtaaccgatccgttattggcggagaaggttggcaaagctgctgcggggttgggaatgaataaatttgctaaagatgctcccgtgcacatactgattgtagaagagtcggctaacataacgtccaggctgggcggcaaactgaaagggaagcattttccgcagatcgatataggcattgcggttgcgcacattgtgctggctgccgaaagcgaagggttgggatcgtgcatactcggctggtttgacgagaaagaggtgaagagcctgaccggcattccgtcttcgaaacgtgtgttgctggatgtgctgattggctatccggtgaaggagaaacggaaaaagatccgaaaagaaaaggagaaagttgtttcttataacagctattaatgaactgaataatctctgattcaccgacccgaacacccccgtccagaaccgcatttcaaccgggacggaccgtcgagaacccgctgcaaccgggactacggttgccggaaccgtcaccgtggggagcggtggaagtcaccgtgaaacgtgctgccaatgggcgtttcaccgtaacacggtgctaagaaaagaatatattaaaagagaaagaagaagaaggagaagaaggggaagaagagaaagaagagaaagcagagctactcccgatcctcctttcacctcaagcacggaacgcgtcgtgtgtagcaccccgtttgggagaagtgaacggaatgacggcaccatcggaggtaaatggcggcagggtgaacggtctctgccggcaggagacataaagaaaacccatatcgctctttgacttatcggaaacgaacattcaccacagaggacacagagtttaattagctgcgctcaatctgttttcagacaaaagaacaaacgaacacataaaaaatcatctgcccttttgttcttttgttcttatgtctaaaaaaactctgtgtaccctgtgtcctctgtggtgagctacaagtctttcagcagcactttgcttgcctttttataatattcctcccttgagtcgagtaatactttccactgttcgctgaattcctcgtctttatctactttgaagtcttctgagccgtaagtatccagccggtcgagcagtaaagcgacgttcagttgattgatgtcgatggaaggctgatatgcgatgtcttcacttttctgatcggtcacaacttcgtggatcagatgaatctcttgcagttgatagagtatctggttggtcagccggatagggatgcgatgctcttcggatatctcttcggcggtgtaaggcgtttcattgttttcaaaacgtttggctataagagacattatcaggatggagatgaagtcccggtaacggcggctgatattctgcgtgtctctgtcgaaactgaagttacggatattctgtccggcgtaggtcagttcggcaccgaacaggcagatggtccatgatatttgcaaccataacaggaacatcggcagggcggcaaaactaccgtaaatggcattgtacttggacacccacaactggctgctgatgtacaggaactgaaatgcctggtaagcggaaccggcaaggataccggagatcagtgcatgcttgaattttaccttcgtattgggcatgaagatgtagagtcccgtaaacatcagccaggtcagcacgaacggaatcaagcggatcaggaatttcaggataggagcaagcaaaacaaaatccgccatactcttcagcatagtgcccacaaagatggaaagacctcccgataccacgatcaggatcggcatcagcaggaacattgaaaaataatcggtgattttgcggtacatgctgcgtccttttttcacttgccagatgcggttgaaggtgatttcaatgttactgaccaggttgagcacggtccacaacaacatgaccaggccgactccgataaaaataccgtttttggtttgtgacagatacgagtctacgaattggaggataacatccgtcgcttcggtggaacctccgaaaccatcacgaaactggctttccatcaaagtggaaacaccgaatccgcgtgcaatggcaaagacgatggccaggatgggcacaatggcgagcagtgtgctgtaggtcagtgctgaggctttgtttacgatgcggtctttgttgaagcggttgacgcagagatagatcgttttgatgatattgtatatcgagaacttggtgcgggtgacttcgctttccgtaatccgccagatatcataggtaatgaatttccatatatcggagagacgctgattcataggtctgttatttgaaattaaaaaaaagaaaagcagtcagcctataagccgagttctgtaccctgaataaatcaaggtgcctgtcatttatctgagtggggtgtcaccacaccactttagcggtctaccctccgacatggagcgagcaactctcataacgccggtttacatgaccttacaactcctaagacgtacagcccgatatgtcaccatacggctggtgggctcttactccaccttctcacccttacctctccccggagggaggggcggttcttttcttctacgttactctaccctcgcggacagctttctgttaggaagtaggatgctctgtgttgcccggactttcctcctgtaccgaaatacacgcgacagaccggccaactgctttggtcagcaaaagtacaagaattattttgtttgagcaaacggaagggaggattagttcggttcaccacagaggacacagagggcacagagtttcacgaatgacataaattcaccacagattacgcagattatcacagattaataatttattttactgagagttaaattaaaatatctgtgttaatccgtgtaatctgtggtgaacatcgtgtgaatcaatttcagttcttattcttaatatttttgaaaaaatatatctaaaacggaaatagtttctatctttgctaaaaatgtaacccccaaatctttctttcatgaagaatatgacgccctttgtatcgctgcttctggcagtgtccgcctgtacaggtattcctgagaacaagaaaaacgcacttccccaagatgtagaactgttgtccggtgaagttcgcaaccggttcattcccgataagcgtgtcatcctttgggatgtggattacgatgtatccggaaagacgattaccgtaaagggggcgactacctcagcggaagctaagtcggctttgttatcgggactggaagagaaggcttatgaagtgagggacagcctgcaactggttccggacagcgtggccctggaaggaaagatgtacggcattgtcaatctctctgtatgcaatatgcgtgtagaggatgatttctcttcggagatgactacccaggcattgatgggaatgcccgttaaagtgttgcaacatcgcaactggtatcgcatccagacacctgataattatatcgcatgggtacaccgggtaggaatccatccggtcaccaaagccgggctggatgcctggaacaaggcagataaaattgtagtgacgtcgcattatgggttcacttatcagcagccggatgaaaagtctcaatccgtgtcggacgtggtagccggaaaccgtctgaagtacgaaggtacgcaaggcggattttataaagtctcttatccggacggacggcaggcttatatctcacgatcgatatcgatgcccgaaaaggagtggcgtgcttctttgaagcaagacgcttcaagcatcatccgcaccgcttatacaatgatggggattccttatctatgggcgggcatttcttcgaagggggtcgattgcagcggctttgtacgtaccgccttatttatgcacgatatcatcattcctcgtgatgcctctcaacaagcttatgtgggcgagcatatcgacattgctcctgacttcggtaatgttcagccgggagatttgattttcttcgggcggaaggccactgccgggaagaaagagcgtgtggttcatgtggccatttatctgggtgataaaaagttcattcactcacaaggcgatgtccatgtcagcagtttcgatctgtcggatgccgattttgatgagtataacctgaatcgcctgctgtatgcagtccgtgtgttgccatctataaataaggaggcagccttaaacaccaccgttacgaatccgtattataactaaactcaaaatagatatgcaaaaccgaagagatttcctcaagaccgctgcttttgccgccataggttcggggctgtcattgcaaggtgtttttgccggcgagaagagccccgcttcatttgcgatcaacaaactcggcctgcgagcaaagctgaaattgcgctttttcccttacgagctgaaactgaaacatgtgtttacggtggctacttattcgcgaaccaccactcccgatgtgcagatagagatagaatatgacggagtcatcggttatggcgaggcttcgatgcctccttatttgggacagacggtagactcggtgatggcttttttgaagaaggtcgatctggaacagtttgacgatccgttccggctggaagatatactggcttatgtagacggtatcactccgggagatacggctgccaaagctgccatagacatcgccttgcacgacttggtgggtaaacttctgggagcaccctggtacaggatctggggactggataaggctaaagctccttcgaccactttcacgataggcatcgatacccccgaggtggtacgtgaaaagacccttgaggtggccgggcagttcaatatcctcaaagtgaagttagggcgtgagaatgacaaacagatgattgaaacgatccgttcggtgagcgatctgcctattgcggtcgatgccaatcaggggtggacggataagaaatatgcattggacatgattcagtggctgaaagaaaaaggaattgtaatgattgaacagcctatgcccaaagcacagttggacgatattgcatgggtgacccagcatagtccgttacctgtttttgccgacgaatctttgcaacggctgactgatgtggcaggattgaagggagcctttacggggataaacatcaaactgatgaagtgtaccggtatgcgggaagcctggaagatggttatgttggcacgggcgttaggcatgaaagtgatggtaggctgtatgacggaaacttcatgcgcagtctctgccgccgcacaattctctccggccgtcgattttgccgatctggacggaaacttgctgatagcgaacgaccgcttcagagggatggaggttgtaaaaggcaagatcacgctcaacgaccttccgggaattggtgtggttaaattatgaacgcggataaacctttgaaactgttttgataatgaaaaaactactttatataattgccgtatttatcagcctttcagcctgtacttcgcggcaggctcccaagccttacaactgggacgatgacttgcaccaacggttgctggcggacttctgtctgaccgaatctcaggtgaaagactatatccgcaaatacattcccgacgtgacggacgaacagatgcgccaatgggaagagagcaaagcgcttgaatgccggatgatcgacggggagaaacgttatttccgcaatgccggtcccaacctgttccggatagactctgcctgctgtgccgtcaaaatggagaaagaaggcacttcattgagcacgagcgaacaagtcaataaagaacatctgcccgaagtgatggctgctgtcaggaaagaaagaacgcctgtcgtgcagcccaagcggatgcgggtcacctacacgctgacggtggacagcaacgcggttcctgccggaaaaacgattcgctgctggttgccctatccccgtacggatcaggcccgtcagcaaaacgtgaaactgatacgtaccagcgagctccgctatacattggctccgccttcatgccggcacagcaccctctatatggagaagcaggccattcccggtgagccgacggtcttttcggaaacctttgaatatacctcgtgtgccgaatggcatccgttgaagcccgaaaatatactgccttatgatactgtcggtgatctttataaagaatatactgccgaacgggaaacccatatccgcttcacaccccgtatcaaagagctggctgccaatctgacagccggtgaaactaatcctttgttgaaggcgcagcgcattttccgttggataaacgatcatttcccctgggcctcggcccgcgaatattccactattgagaatattccggaatatgtgctcgacaatcgtcacggcgattgtggccaagtgagcctgttgtttatcaccctctgccgttgcagcggcattcctgcccgtttccagagcggctttatgatgcatccccgtgcatggaacctgcacgattgggcggaagtctatttcgaaggcgcgggctgggtgccggtagatcaatcattcggcattcccgcatttgccggcaatcccgaagaaaagatgttctttctgggaggtatcgattcctggcgtatgatagtcaacagtgactattccatgccgttggttcccgagaagaaatatccgcgtagtgaaacggttgatttccagcgtggggaggtagagtgggaagggggaaacctgtacttcccgcaatggagttatcatatggatatagactacttgaattattaagttcattctccataaaaggcttaagcgttttccgaaaagacttaagtgtttctcaaaaagactttggtctttcgagggaaacgcttaagtcttttttctgccttctaaatacttgtgtgtcatgcaacgaatgctaatttgtcagtctctgccgttaaccgctgttaagctctgcagattcactgttaaaagagaacaaaaaagagtgacaaggagaataacagaatgatttttgtcgttattttaacgtcgtaaatgttaaatgaaagtagaatattaacaattaaatgaataaaaagaatagtatgaaacagacaacaaaaaacattcttggggtaggagcggttgttcttctcagcgcaggagttgccggagtgacaacgtatacgatgttgaaaccggaaaacagagacagcctgtcgttcagcgaacagttccgccagaatcccaatgcccgcttggctgcttatgacgccattaatgcacagcctgtggatctgacgcaggcagcagaaaattcgcttcatgctgtggtacatataaaatcgactcaacaagctaaagaacaaacagtcaccgtgcgagatccgtttgccgagatcttcggagatattttcggtaatggaggcagacagcagcgccgtgtacagacccagccgcgtgtcggtttcggttcgggagtcatcatttcgaaggatggctatatcgtaaccaacaaccatgtgattgatggagcggacgagattgttgtgaagttgaatgacaaccgtgagtttaaaggccgtgtgatcggtaccgacccgaattcggatctggctttggtcaaaatcgaaggaaatgattttccgaccattcctgtcggcgattcggatgccctgaaagtgggagagtgggtcttggcggtaggtaaccccttcaacctgacttcgactgtaaccgcaggtattgtcagtgccaaggcacgtactttgggcgtatacggtattggcggtgtggagtcgtttatccagacagacgccgctatcaatcagggaaacagtggtggagctttggtcaatgcaaaaggtgagttggtaggtatcaatgccgttctttcttcacccacgggtgcttatgccggatatggttttgccattccgacgagcgtgatgaccaaagtggtcagtgacctgaaacaatacggaaccgtacagcgtgcattgctgggaatcaagggtacttctctcgcgggtgacggcgacatgatgtccgaccagccgattgacaagtcgggagctactttggccgataaacgcaaagagtttggcgttgtagacggcgtgtgggttcgtgagattgtggatggcggttctgctgccggttccgatatcaaggtggacgacatcatcatcggtatcgatggtaagaaagtacagaacttcgccgatttgcaggaagccattgcacagcatcgtccgggtgataaagttaccgtgaaggtgatgcgtgacaagaaagaaaagaatatcgacgtaacgttgaagaatgaacaaggtacaacaaagattgtgaaggatgcaggtatggagattttgggtgctgcctttaaggagttgccggacgacttgaagagacaactcaatctcggatacggcttgcaggtgaccggagtgacttcgggcaagatggcggatgccggtgtacgaaagggcttcatcatcctgaaagccaacgatcagccgatgcgtaaagtcagcgatcttgaagaagtgatgaaagctgctgtgaaatcaccgaaccaggtgctcttcctcacaggagtattcccttcaggaaaacgcggatattacgctgtagacttgactcaggagtaaattagctgaaagctgctgtgtggtgagtatggtcacaccagcgaatcgtctgccgaaaaaagtaattggtagcttaataatagctaaggaaatcgaaaagagagtgccggcaatcaaccagtcgacactctttttgtttgtagtagtagataattaatggtgaaaaagttgtggaaatttatacgttaacaaataaattgtcgtaactttgcactccaaatctgttttataagaatgagacaactaaagattaccaaaagtatcactaacagagagagcgcttctcttgacaagtatttgcaggaaatcggtcgcgaggaccttattactgtggaagaagaggtagaactcgctcaacgcattcgtaagggtgaccgtgtagcattagagaaactgacacgtgccaatcttcgtttcgtcgtatccgtagccaagcagtaccagaaccaaggtttgagtttgcccgacttgattaatgaaggcaatttaggactgatcaaagctgccgagaagtttgatgaaacacgtggttttaagtttatcagttatgctgtatggtggattcgccagtctattttgcaggcattggcagagcaatcccgtatcgttcgtcttccgttgaaccaggttggttcgctgaacaaaatcagcaaggccttctctaagttcgaacaggagaacgagcgtcgtccgtctcccgaagagctggcaggtgaactggacattccggttgacaagatctccgatacgctgaaagtatccggccgtcatatttcggtggatgctccttttgttgaaggagaagacaacagcctgctcgatgtgttggtgaacgatgattcgcccatggcagaccgttctctggttaatgagtctcttgcgagggaaattgatagagctctttctacgttaaccgatagggaaaaagaaatcattcagatgtttttcggtatcggacaacaggaaatgacattagaggaaatcggcgacaaatttggtctcacacgtgagcgtgttcgtcagattaaggaaaaagcaatcagaagattaagacaaagtaatcgtagtaaattgctcaaatcttacttgggataagcaagatatatcagtttccgaaaaagtatttaaaaaacgcttcatcttttgatgggcgtttttttttgttatctttgcgaagttaaaataataacagaatatgaaatacgtaaaaatactgtttgccgtagcgttagtgtttacattgtgctcggcgttttcgttgaaaaaaggagaacataagcccgtttatgcttttggagtatcggcgtcatttaccgatacagtggtatactacaccgagattcaggtactcgatagcgtggcgctggataaaaacggatttctgccgcatagagagatatacagctatcaactgaaaaactatctggagattgataaagggcagtccaaccgtacttgcatgatctacttctcggagaatcagaagaaacttgaaaaggaagctgcaaaggtattgggcaaatataaaaagaataaatcggtggcgcttgagaaaatagatacccaaagttttaaattcactaaaccggaagaataacttaaacgttatataagaaggggatgcttagaagctcctgatggaggagcttttaagcatccttttttttaggttttaaattcaatacagatatgaaatcaaaaatgattcttttttttgtaagttttgtcatgttgttcagcgcttgccggaatgaagatgaacctactcttccggcgtatggttcgcgtacggttttaatttatatgatggcgcaaaactctttgtctccatttgcccggctggatatggaagaaatgataaaaggaatgaagcaggtggatgcaacgtctaataatctgttggtttatatcgatgactattcggctccccgtctggttcgtttgggtaaaaacagtaaagggcaggttgtggaagaagtggttgccaactatccggaacagaactcaacggatgtggctgttatgaaaaaagtcatttcaaccgctttcaatacttataaggcagagagttacggtatgggcttctggtcgcatggagaaggatggataccctcgccggccaaaacgcgctggttcggacaagacggcaatgattatatgaatatagacgatctgcacgaagccttacaggtggctccaaagcttgatttcttgctcttcgatgcctgtttcatggagtcggtggaagtggcttatgctttacgtgactgcggtgactatatgatcagctcgcctactgaaattcccggtgtaggagctccttatgaagacgtggttcccgctatgtttactgccggaaacccgaccatgaagattgtctctgcttattatacctactatgaaaacaggtataacgacggggtagggctgactaatgaaaactggaccggtggggtttcggtgggagtcgcaaaaatgagtgaacttgaaaatctggcagctgccacagcaaagatacttcccaaatatgtgacgggaaagactgatttcgatctttcaggggtgatgtgttatgaccggagatacctggcgttatatcatgacctcgatcagtatatttacaagctgacagccggtaacagcgattatgatgcatggaaggcggcttttgataaggtaatggtttattggaagtcgactccgcgcaactattcggcatacgtcggcatgtttaccatggactcaaaggcgaaagggctttccacttatattccaatgacgaatagggagtctaccaatacgtcctaccgggatacgggatggtataaggcttccggttgggcagataccggttggtataaataagcaataaaagtgaggctgaatcaaaactcaccacagaggacacagaataacacagaggcgattttaagttattgattattagttaaaagactctgtgctactctgtgttactccgtggtgaaaagagttttgacacactttttatgcattgtgtcaggtcggccacctgtaacggttttagtacttatgggatgaattctccttttgcggtgattttcacttttacttccagctctcctttttccagttcaaccagatagtattcgcctgtgggagtttcaaaaaagtcggcttcatctacgtgatatccggcatattgtggtgaagaggcaattgcattggtcacctcaaccggtagtgcattccggtgtacgtcccaggaagtgtatgcccattggttggagctgttgaatacaacctctttgctgatattgttgtggataatatcgacttctgtcattccatgttccacttcaatctccgccaggcgcgcattcggatacttctcttttataaagttctcgatggctgcggggacttcggccggaaggtaatttcccgaatcattgtccgtgtctgcaacgcttttaatcaggattccttctgccgaataatacaggtcgaactcttgtttgccggattctacttcgatgatatatacggtttccatatccagacgttccagcatatctacatcatctattttccattttgcatattcactgctttcaaaagcactttttaccgctgagggcagagcctgatatggaatgtcggtttctgtcatttgccatgttccgtccggagtaaaccaagcagaggtttcatagttttgatggcggaagtcagccacataatagttaccttttgtttcccacttttcattgctgactgtcgggtactttgcggtgaatgcgtttttcagttctgccggtacataagacagatcatcatcatcatcgttatcacagctttgtaatcccagggcacccagtgccaaaagaagaaaatacattttcagtttcatttctactatactttttttagttgtcaattcatgtcatgcgcatattgtaataaagcggaattatacccgtatatgtgcgtaacatcagttatcaatatcgattaaattaaatttagagtcgaattttagttcccatccgttggacagtttcacttcataatccgctttatcacgttctattttcagaatcttcgcgtccgcatagttggtggttacgtacttctggataggagcgggtattatgccctgtggcactacactgaatttgcaatttacttcagtccagtttcctttcttgtcgaattccactttgttgccgtcggtgaaaatgacgtcgtagcttttctgtaagaaatcgctttcaactttggccatggcaatgttgttgccggcaaaatgttgtttgatgaactgctgtgccttctgcggcatttggcttacctggataggtttatcatcgtccgctcttgcgatggtttgcagagtgaacaggcatacgaataaaagaagtaactttttcataatcgtctttttttattggtttttacttttagcaattaatttataatgcaaagatgaaggtcgattctgaaaagaattgggaattctctccattttgatacttttttctaaataaaagttcgattactcttgttcatccggttgaacttatactgtatatttacataacatttaacgctgagcgggaagtccttctcgcaatagatatgaaaagattttgtacaggcaggtgtgccggggagtcgtattcaccacagattacacgtgtttgcgcagatgaatgtcgccggttctcagtggattaaattcgttctgtgttaatctgcgtaatctgtggtgaaattgttcttccgtaattcgaaacagtgttcatctttctcaaaataatacctgagtgtgagatgctgtaatttacagatggagtcggctatggcaagtcccagtccggtcgaaccttcctttttgcttccctgatagaatcgttcaaagatatgggtcgcatccaagggatggtctgtgccgctattcctgaaggtcatgctatggccggttatttcaatccggatatgtccactgtctacgttgtgtacaaacgcatttttgagcaggttcgttatcagggcgactgccagtgattcattcatctccgcccggaatattccctgttcatctaacgtcagctcaatttcccgatagccgtatacttcttcataatcttctatatatcgcttgagcatgctgttgaactccaccgtttgggtctcggagaattgtccgttatctattttggatagtaacagcagtgatttattgagcttggtgatatgctccagggtctggtgcgtttttatcagctcttccaactgtgcttcagacaaggagtcgtcttccatcagcatttccaggcgattccggcagatggctaacggcgtttgcatttcgtgtgaagcattgccgatgaattgcttttgttgttcaaagatgtgctcgcttcgttccgcgttgcggatggctgcttcgttcagcttcttgaactccgtaatttgcgtttcattcttcaaagggcgattgggacggcctatcctgtaggcatccagccagcgcagcagattgtaaagtggcttcatgctgcggtgaaatatccagatgcagacaatcaggatggtgagcagcaggacgatgtacagaaaaataatccatcccagcatggcgtctttcaggtcgtccttctcgatcgtcggtgtcgatacggtaagctcgtaatattgcccttcgtcatctttgaataaggtggtcagtatgcgtgccggttcagtctcttccttctccacaatataaaccatggagtctttgtagcagatatcttcgcgttcgtcggcatactctttacttacttttctaagatagtattgattgttcgacccattgtttttcgagggcagttcttctccggccaaggcacggataatgatggtttccgagtaatcctccagagagtcgtctacttcgtcgttcacttcatctatcacggctatatagaaaaatacagcccatgccccgagaacaactgtcagcatgagtgcgatgcggattataatacggtatatcaacttcatggaggtagagtcttttttattcaacagtcattttgtagccgaatccatatacagccttaagttctgccaaggcaccggcatctttaagtttctttctcagattcttgatttgcgcatagatgaaatcaaaattgtctacctggtcgatatgatctccccacaccgattcggcaagtgtgtttttgtttaccagtcgtccgggacggttggcaaagtaaagaagaatatcatactctttgcggtttaattctatttccttgtcatctacgaatacctggaatgtatcgggaacgatacgtatgttggccaggcgtatgtccatttctccgtcgcggcgctggcgtcggatcacacttttgatgcgggcatttaattcggccaggtgaaagggtttgggcagatagtcgtcggcacccagttccagtcccagtactttatcgtccagggagtctttggccgagatgataattacattttcccgtttatgcatcttcttcagttgctccagcagattcagcccattgccgtcaggcaacataatgtccagcaagacgcagtcgtaatcgtagtcctctatcttgcgtaatcccgactggaagtctgcggcagcttccactacgtagcgttctttttcgagcgaacgctggataagttccctcagtgagggttcgtcttcgattattaatattttcatagggctttttatttctacctgcaaagaaaaggcttatttctgaaataaaactgaaaagaaaagctattttatttttctatctcaacagaagtgtctaattttgtttccaataaacaaaaataacacgagtatgaatctctaatactataatttatcatgttgactcaaattatcaatggacgcatatttactccgcaaggttggttgaacgaaggttctgtgttgatgagagatggaaaaattctggaagtaactaattgcgacctggcgctgatcggtgccgatctggtggatgccagaggaatgtatattgttcccggttttgtttgtatgcatgcccatggcggaggaggacacgattttacggaatgtaccgaagaggctttccgcacggcgatagctgcacacatgaagcacggcgccaccagttttttcccgacactttcttcttctccgttttccgaaatacgcaaagctgtagatatatgcgaaaaactgatggccgaacccgatagcccgatactcggcttgcatgtggaaggcccttacctgaaccgtaagatggcgggagaacagttttcaaaccaagtgaaagaagtcgatgtggcagaatacacctctttgcttgaaagcaccgattgcatcaagcgttgggatgcctctcccgaactgcccggagcacttgactttgcacgttatctgaagtcgaagggcattgtaggagctgtttcgcatacggaagccgaatatgatggcataaaggaagcatatgaggcaggatttacacatgctgcgcacttctacaatgcaatgccgggcttccataagcgtcgcgaatataaatacgagggaacggttgagagtgtctacctgaccgatggcatgactatcgagctgattgctgacggcattcatttgccttccactattttgaaactggcttataagctgaagggagtggagcatacttgcctggtgaccgacgcactttcatatgcggctgctgaaggcaaggcaattgacgatccccgtattattatagaagacggtgtgtgcaagcttgccgaccgttcggccttggcaggtagtattgctaccatggatcagttggtgcgtacgatggtgaaggctgatattcccctggcagatgccatacgtatggcttctgagactcctgcccgtattatgggagtttatgaccgtaaaggatctctccagaaggataaagatgcggatattctgatcctggatcgtgatctgaacgtcaaggcggtatgggctatggggcagttggtgaaggagtcgtaaatagttcactacggattatacaaatttactgttgccctcttatgccggttatttgtaagaagggctttcaatagaaattgttagtgtcgttactattcttattctattcttataaatggaaggggaggaggataagaatagtaacgacttactttaatctgtggttcaattaccgttaattttcaacttcgtcttttcttaaatcggtatatttccttattctccctttttctctgatcatttctcaattttctgaaaaacgcccctatagcctccttatacggccatccttttacttttaaaaccaagaccctttacctctaaaatcaacgcttccttggttttaaaccaacgagcctttggtttaaaaggtaggcttctcccgtttccatcccaaattttgcttgtgaaaatattgtataactaggctttacggatcgcaaatgtgttcttccgaattgcattggcacttgctttaattgcacctatacctgctctgattgcacccatatctgctttgatcgcaactatacttacttcaatcgtaactatccttttcggtccgccacttatcccttttcccggaaaacattcccttgtctctctattgtcttcatcttcaatctttttcttcctttcgtttcttctcttcctattacctgatttaacaggatgttaaatcaaggcttttgtctccaaataacaagtcttttcgaagcaaaagccttgttatttccatccctgaaataaatgtttccccaaccgcattaacaatgttaacgcaggattccgttcaattcccgtctgattcttgtttgatccttgtctgattactgtttggctcctgctcaatttccattcaatccccgtctgattcctgttttaatttccgtccaatcctcgtctgattcccaccgacttttcagtttaatccctgtttgactcccatctgactcccatctgattcccgttcactctccattcagtccctgtccaattccagtttcatcccctccaattttcctccaattccctatttttctccgcaattccaccccaaaacactcgttctcctccctttcgtagcacatatcctttccgtcctctccggaaaacttcccccttatataatataataatgtgttattttccttcttttcctttccgttccccataatcctgttttaaaacctacctctccctcagtcttttacatataaatttatatttttattcaaaaaacttccttatatatttgccttgtattggtaaatcgcgtacttttgcacccgctttccaagagacggagagccgattgaaattgacatgttgcaagtgcgtattgattgccttaacggatcaccaaaataatctcctttttctttggagtttaatattaaaattcgttatctttgcagtccgattcgcgataaaaggcgtttattccggtgcctttccctttcgctaagagagtcggagaacagaccgggaaaacattttaaaaaaaaacttccagaaacatttggtgttttaaaataaacctttaaacagccctccacgtaaacagaaattaaacctgcgtaaacgtttcgttttgcggaagttccttctatccttccccgtaacctattgtattataaagcgatgtgttgttttattcaatatatcgttttatacgcttcgttctgtgccccgtagtatatcaacataagggcagagagtagagaaagtaactttttattgtcctgtttgcattctggtccattggtaatccggaggctccaatggttgttcaggtgcgacacgttcatattaatgtaacctttgcaaggtgtggcatcgattattttactcaataggcattgtaaggctgcagtcatggtaatttcgtctacccggcaactgatatagccgaaatctttgctgacgtttaattgtatctggcgagtattggcataactctggcattgattggtgattgaggtaatgaaagtgtaaagttcaaactcaatgggagaaccaggatatatttcattctctatattgctgaatattccaatattctggtagctgttcatgatgtggctggtgtagccgagcactcgctttaacttttgagatgtaggttcaggaaggttgtcagaggcgatttcttccagtaagtgatgcatcagagtcagtggggtttgagttttatgagctatgttttgaacaatgcccagtttttcgtgggaaaagagtttcgtgttatacatgattctataacgtatcatgagaacaataaacaaccctattactaaaccttcaatcgggtatacccatgacatttgccataagaaagcaggtataaaagtagctgtttggtactgacttgtaaggtcgagttgtacatcggtttgcatacaaggacatacatcattaaatggtgtgtccaataagatcaactgtaaaaatagaataactggttccataactgtatttagataattattaatattgttttcatagttaaaccatcattttttcaaacttcttttttggggggaattcccaattagtcgttggtgctgcaattatagggctttttgtacagcttgattgggtataatcttttaaaagatatgggtaatatctggtaacggattttaatgtatatatttacgattgttttagactttgtcgtatggaggggattttatagttgtgaggtaatcaggtttattttcatgatctatgcttcacttatcagattttgcccgcttattatttatatttagatactgattggttacataaaaaatggcagaaataactcccggggataaaaagaaatcctggttacatactttatggtaccttctgatagtggaataatcgtaatgtcagaatagctccctttatgtttgcagatgcttttatgaatgttttgttgtttttaaatgtttgatatttaggcggttattgaatgcagagatcttttccttagacaatttttttgttttatacattgagttgggggagagtgaggctgttaaaacaatattaccctgacacccagcctcgatttcttatctgttaattgtatgtgcttcttttaattaaaaagagtgtattactttttattacctgttaatgggttggtttttaataatgtgatggtatgtaataaattgtaatgcgttgaaatggatgtattatgtcaaaatttcttttttagcctaatcgttaaattattttagaatttaatatgggaaatgccgtgaaatcaataatcttttgattattgttgtttgaggtaaacatttagggttctattttttatatcaataaccgggcgattgtatgtttatcctctgttaatcagtgaaattggtagtgagattttgagataatattgtaaagtattacatttgtttgcaaaaacaaactacgatgaaacgctctagattatttttatggattttgggtataataatgcaagcattcttggtcagcattcatttctatcagaaaaatgtggaggcaatgcgtaccgaatcggaagaccttttagtagaagtgctcaagaaagagttgcacagaaagcaacaagagttgaatctgttttatatttccaaagtaacagtcgatacggttcctctgataattcgtgttacgacaagtgaaggagttaagtcctatgccgtggacgcaaagaaaagtaaaaagaatatttcacaaaatatggcggagcgatcttggcattcggctgtctgcatgaagagtggtctgtctgtagatactttacatcaactttgggacagagggctcaaaagacataaaattttcgctaaaaccgatgtgcacatgtcaataacccatttggataataccatttcccattttaaatgtaaaaatagcaatgatctttgttccgtaacacaaaaaattactgtttatataggcaatagatgtgaacttgagattattggtttctggtcctattcatggtggactgtatatcagtatcattctactccttttgaagtgataggaagtgtagcggccgctcttatcattgttttttgtggctggtatctggtaaagaaatatataactaaaatccgaaatgataaaagacatttagccaatgactgggatcgtgaaagaaaggttcgtatacaattggaaaaggatcagaaaaggttggaggcaaaacaaagagaatatgaaaaacggattaaagacctttcagcaagaggcgaagagtatgaagaagaacgaaaaagtatggagaaaatactgaaagagtatgagatacaaattcaaaagcttaaagaattaagggaatccggaaaagaaccattactttatatactgagtccgagggtcacttttgattcttatgcaaagttattaatttgtggtgatcaaaccattcctcttacttcacaggcttgtagacttttggatgcttttctgaatgctccagattatattttaacttacgaagagctattggaatgtttgtggaaagatggtagtggaggcatggttcgtttgcgagtggctatttctcgtttgcgtattgtgttaagcgtagatcctgaaattactgtttttcaaagagatattgataaatatcaattaatacttcctgaaaaggaataatttagggaatcttttatactatgtaataaattgtaatgtataatatgatgttttattgagtaatagcctttaactttgcggtgaataattaaaacatatatcttatgaaaatgaagagctatttgaaagcaacttttcttttggttgttatcatttcggtttggtatttaaaaccggtgcagaaatctcagaatgtagatcctcttttattgcagaatgtagaagctttggccagtggcgaagaatcttcgcagatccattgttattggcgtggatctgtagattgtcctgttagtcacgataaggtggagattgtatatgaggcatgaaacgtaggatattaaaagaacacttagtgttcctttagctgcgtgtttatcaaagggagtggaagtatttctattccctttaaaacaggcaaatcagtcacttcctaaaggactttaaagtagaaacctttaggtctgaaagctaagtaaagcttttagtccgcctaaaatcggatgcttatgaataaaaatgtcagtgtattaatcttaatagggattattctttggggatgtcatccggcaaaagagaaggttgagttttcaaatgaagttatttgtagcgatagcatatcacgggaactggttgttttaaatgatacgtttttattttcgtatcctttgcaaatagagcttatagactcaatgctactggtgttggataatgttaataataacttctttcatctgtttactctaaagggagtacctgtaaaatcatttggagaaaaaggtcaggggcctgctgattttataaatgtgggggcattcaatttatctgaagatggaaaaaacatgtatgcatacgattcttcaatgcgtaaaatagtgaaatatgatgtctcttcttttttaaaagattcattgaaatttgaagttatgcaagtgaattatggtagcttgccacactctgaggtacccacaataatctatgatatgctttctcttaaagattcggattttcttgtaaaagcgaaccataaggatcttcggtttggattattaaaagatggaaagattactcaattatacaattctttctctgattgtttaaatacaaataatgaagaagaagtatggtcggttttctgtagtaataccaaaaccaagttaaaaccggacaggacgaagatgttgaatgcgacctatctgggagggatcctggagctatttgacttggacgaaaattgtcgtttgtcattgaataaaacgctttatatttacgaacctaaatatggtattgctgaaggagcaattccggcgtatgtagtttccaatgaaacgactcagattggtttcgaagatgtatatgcaacaaataatagtatttatgcattattgcataatagaggaagcgaagctttaccttcagagattactgtatttagttggcaaggacttccaacaagtaaaattaaggctaaccacggtcttgtaaatatagctgtggatgagaaaaacaatctaatctatgtaattgcggaaaatgaacagaatgcttatgaactgtcttgcttatctttaaattgatgtgtattctacaattttcaagaataaagcaagctgtctataaacggttttccgcttaaatagattcactacggggtgatgctactaaaaaacagaaagaagttgagaaaccaatcttaaaacggcaaatcactttactaaaagctctaaaacgcgagaggtaaacttgctcaggtcagtaattaaagttcatcttagcacgcaagatgtacatcttacgcaccaagatacacatcttgcgccttaagatgcgtatcttggctgtcaagatgaacttagactgtatgaagaaaatatttttctaagaatcataagatactttaatctgcatcttgtggaatttgagtgttaacttcaataacttgccattgtgcttcttctaaatccgtacaatacatatattgtcatgaataagcagtatgttagttattatttctttcaaaggaataagaagttgatgcatataaaggcagaaaacctatttatacaagtgttgaaagatgaaatgaaaaagaaaggggaagcattggatttattttattctttttcagggatatcaagtgacacgtatttcgattatgaccgaaaccggatccagacagtataaagtggatgttgcgaagagccggaaaaatctttctcagatatcgagagaacgttcattacactctgttatttgttccgagaagcagttatctcccatgactttgagtcagacctgggcggatagcctgcaaacacgacatattctggcaagagttgcgatagaaatagtaactacagacttggaaaataggatcttatatagaaaaagccaaactgtcaatctgtctccagagttgaagtttgttgtttatttgggggagagatgtgaaatagaggtttccggttttttattttatacttggtggtcggtttgtagatatcatttctttccattcggaatgattgttggtatagctttgtgtttgattgtttttttgatctatttgtttagggtgagaaagcacttgtttaaaacacagtctgagtgtggactattggtggagaagctaaacaaagaagaagaaaaattagaagagttagagagtatatgggatcaatatgcgcaacaggttgaaatggagcaatctgatgctcgggaaaaggacatgctgttgaaggatctggagcaaaagtcaaaggcgtacgaagggcaaatagcggaactaaaaaaggcaaaagaactgttgggaacaaaatccttgatctataaattgagtcctatactgacctttgatgtatataaaaagacactggagtgcaatgaggaaataatttcacttaatctccagtcctatactctcttgctggttttcttaaatgctactgattgtcaattgacacgtaaggaaatcgagatgtgtttatccagagggagccgggagtgtttccggacagctaagcaccgcttagttaaggtacttcaaattgatccttctatttctattgttcagcacaatagggatctttttcagttgcaactgccggaaattgaggtcttgtagcgctttgtaacgcactatatggtgagtataagaaaaatatggcttatatttgcacgtatttaaaacgtatatagacatgaaaaacactttggtataacttcctgcattgttaatctaatctaataaagttatgaagaatatcttgttaacacttctcttgtttatacttttttcatgtaaaagtactggagataaaaccgactgtgaagtattacatgtcgatttggttgaacgccctgttgcaacggaagaattattttctaaaatatctgtcattccattggaaaccaatgatagctcctttcttgtaaggcctgtgaaagttattattaaagataacagatattatattgtcgatgaaggggttccggctgtgttttcttttgatgaagaagggcatcttttgcataaaataggtaaaaagggacaaggtcccggagagtatcgtgaaatatacgatgccgttattaaagaaaaagaaaatgcagtgtatatgctatctccatttggctctctttatgtgtattctctggatggaaaattcataaaagaaatagaactgccaacgaggtctaattatcaattggtagaggaactggagagtaagtatttcgttacatggacattacctgcttctgagaatgataattgtatcagcgtcatttctaaagagtctttcaagaatgtgaaagaattttggcatgtccctcccgttctcactactctgaattctaaacctttttataattatgaacataaagtatatttttccaatccttatcaaaatgaagtatatgaagtaaggacagatagcttacgggttgcataccgttgggattttggaaaagataatcttgatttaaaggagtatggattcactttattagaggataaaaaggttgaagaatataaattaatgttgcagtatttacgtgattctactgtgccttattttttatgcgatcaatatcagaatgataaattctattatatcatgttggtgttcgggcttaagcattcgaaaaatctattttatcggaaggaagacggtaagagtttcttttttgaaaaaacaacagaaggcattcattttgaacctttagcttttaatgaagatttcctgacttgtattgttttcaatgaagactttccaaactatgaaaaagtgcttcctccagaggaatatcagaagctggaagagcgtttagaagatgataacccctgtttaatcaaattttattttaaatgaaaaattttatatttgtactgggttgctttctctttctaatctcatgtcagcagaccgagaaggaaaagcttgaagaacttgttaaaaattggaatgggaaggaggtactatttccgacaaatcttagttttacgctatatggaaaaactcctgtcgattttaaaatccctgcttcggattataagatcgtgacctatgtcgattcgttgggttgttccagttgtaaattgcaattgcctaaatggaaggattttatgaaatatgcggattctatagtaggctatcaaataccggttcttttttttcttcatcctgctaatgttcgcgagatgaggtctgtgttaaaacaaaatcgttttgattatcctgtttgtatggatacggaagatacttttaataaagtgaataagtttccttcacagctaaattttcaaacttttttattagataaaaacaatcatgtaattgcgataggaaatccggttcataattacgatgtaagagaactctatatccatcttatttcaggaggaatagatggagattctctttcaaatatgcgaactgtgataaaaatagagaaagatatggttgatttggggagttttgattggaggcgagagcagcatataacttttgagatacacaatattggtgataataatttagtcgtttatgataataagacatcttgcggatgtacttctgttgaatactcgaaagaacctgttcagcccggaaagtctttagcagttaaagtaacttataaagcggaccatccggaacactttaataaaactattatactatattgcaatgcttccgcttctcctttggagttaaagataactggagatgccaaataactggaacatataatgaaataaatttctatagggcgagtgctgccagttgtcttatttgtccttgatagtcactgtagtcgcaacttttgcaggctacaatatatatcagtcacagagagtagaaagtatcatgtcggatttgacgatggccaatgtagaggcgttagctggttctgagattaatgatgaggattgtgtcagtgcatctaatcgttattgctctgttttgatagtgaccccaaatggaaattatctagaaacttattttgaccaaaaaacaaagtactgattcttataaaaagtggggataggaatattggctttgactagtatattttattccctaatttattattatgaataaaattgtatcgttttttattttaattcttgtttgttcttgttcagataagaaagagcatatagcaaatattctgtcaatgaattctatagatattaaaactaataggattaataaagacgaagtaattgctagaggtgcatttccttttgaaatgattgattcattattctttcttttcaatggagatccttcgtctggagcattggttttatgtgaatcgaatgcttccgaactgggacacttcttgcaaaaaggaaatggttttggagaatgtatcactcctggatatataggacattgcaatgatactatttatgtttctgaacgttctaggacaaggcgaatgacttatttactatcaaatcataatgatagtttgcaatataagtgtcttgaagatgttagtcctaaaatgaattcagaattttattatcagatttgtcgtctacaaagtggtttatttgtaggtgcccgtttatttggaaaagaacatttgtttacattgttagacgaaagtttggatacacttaccacttttgcacgggtgccgatagacattgaggaaaatgcaaataataagctcgctccttttattggtcatttatgtatagatgataatacggtttattatgcttctaatgacttttcttatatggctgcttatgatattttatctgaaaaagagataaaaccagtatttgagaggatgtatatatctccaataatccaaaaatcagcaaatgggatttcattagataaatacaaacatcttttgggctttggtgatatcagggtttatcagaattatatttttgcgacgtatatagggaaacctgatataacaatggatcaagagaatgatacttcagccttagtccccacccatttgctggtttttaataaagatggagttcctattgtaaaatttaagtttccgtttaaaataagatcatttgtatttaccaaatccaagatgtatctattagatgtggattgtaatatagaatctgtcgatttggtagagctgtggaagcatttgcctgattgaagtgggatagtgactttatagaataaatgtgaatcatatgagatttaatttagtcgttttatttgtaattttactttctttctcttcttgtggcagggaagaaaaaactgtgtatgattttcctttagaacaatcgcttaagagtgataaggaagttagtttaaacaaggaactattagctccctatctgatgtgttcttatgattccactctgtgtctaatagattggactgccaatccgatggtgcatgtttataacatgaatacagggaaagagatggttgcttttggaaataaaggcatggggccggatgattttctatctatatcccaaatgtatgtagatatgggtaagcgttctttggtactgtatgatcagtctttgcaaactataagttcttttcgaattgatagtttagctcaaggcagtctttcaaagatagattgtgtttcagctcctaagttaggaatgaatagggtatatgcatattcggattccatattttacgggagtgggacttttgaaagtggcctgatagcgaaatgcaatcagaaagagattttaaatcaatatctcccttttccacaaacagagcaagcggtaaacgggatgtaaactatttgttgttccagggggatcttattatgaagccggataaaaaacgttttgcttacttggcgtatgagtgcgatttattatctattcagaaagtggtaaatgatacgtgcctggaaagtgtagtacatttgaatacgtatacgccggtatttgagaatcaatctactaacgaagtgtcttctgttaatgtctctaccgattctcctaaaggatttcttcgtggggtagccactgaaaactatgtttatgcactttacagtgggcaaattgggaaaaataaggcaatagcaaatgaagtttatgtatttgattgggaaggacgtgctgtaaagaaagtgatactggatagatggggtatatgcatctcggtggatagtaatgatgaacgactctgcctgatgacaaaggaaacggatggtggagaagagcgctatcattattattgttatcagttaaactgactttttggttagggtgttacggctttgcttgatatatatattttttatctttcaaatttttcttcatgcaggggccttttctcgaattgtgtaaatacaaataatgaagaagcatggccgtaatgaataagagctaattagaatttgacaggacgaaaatgctgaatgcaatctatattggaataatctgaattgtacaagagttattgtttgtgctgaaaatgaacagaatgcttatgaatagtcttgtttgtttttttttattattttcttcgatgtctttgtttttgtagtaaataatcttatttttgtcagtaaaataaatcgaaatggtaagaacagtttttcacttaaatatattgatatgaagtatattcggttattgctatgcattgtggggatagtgttattagcatttctggttagtttgtatttctttcaaagaaacagaaagttgatgcacataaaggcggaaaatctgtttacacaagtattgaaagatgaaatgaaaaagaaaggggaggaattggatttattttattctttttccgggatatcaagtgacacgatacctttaactatttcgataatgaccgaaaccggatccagacagtataaagtggatgctgggaagagccggaaaaatccttctcagatatcgagagaacgttcattacactctgttatttgttccgagaagcagttatctcccatgactttgagtcagacctgggcggatagcctgcaaacacgacatattttggcaagagctgcgatacaaatagtaactacagacttggaaaataggatcttatatagaaaaagccaaactgtcaatctgcctccagagttgaagtttgttgtttatttgggggagagatgtgaaatagaggtttccggttttttatattatacttggtggtcggtttgtagataccatttctttccattcggaatgattgttggtatagctttgtgtttgattgtttatttgatctatttgtttagggtgaaaaaccgtttgtttaaaatacaatctgagcgttggctgttagcggagaagctaaaaagaagggaagaaaaattagtagagttagcgagtatacgggatcaatatgcgcaccagattgaagtgcagcgatctgacgctcgggagaaggacatattgttgaaggatctggagcaaaagttgaaagagtgcgaagatcagatagccgatttaaataagtcaaaagaaaaattagtagagttagcgggtatacgggatcaatatgcgcaccagattgaaatgcagcgatctgatgctcgggaaaaggacatgctgttgaaggatctggagcaaaagtcaaaggcgtacgaagggcaaatagcggaattaaaaaaggcaaaagaactgttgggaacaaaatccttgatctataaattgagtcctatactgacctttgatgcatataaaaagatattggtgtgtaacggggaaataattccacttaatcttcagtcctctactctcttgctggctttcttaaacgctactgattgtcaattgacacgtgaagaaatcgagaagtgtttatctggaaggagccgggagtgcctccggacagctaagcatcgtttatctaaggtacttcaaatcgatccttctatttctattgttcagcacaacagagatctttttcagctgcaactgccggaaattgaggccttgtaacgctttgtaacgcggcaaatgatgatgataagaaaaatatagcttatgtttgtatgcattttaaacgcatatagacatgaaaaaaactttaaaagtagctattcttcttattgctattatttctatggggcactggatgcctgtgaaacaagttcgtgatttaaattctttatcacttcaaaatgtagaagctttggctagcggagaaactcctatttatacttcttgcattggtacaggttctgtggactgcccaattcaacatgataaagtgaagtatgtgagccaaggatttagtttggattattagaaatattaacttggttagaaagggagtggaacgatctacgtcctgggaaaagtcttagaatcgtccactcccggataaccttcaaaaaagaagtttgcccggcacgaagatagcgaaaaattaattggaatgagtaaatgtagcatttactttttctacggaggaggtggcttcccgaaagagagacacgacaaataacagaattactaacctcataaaaaatatataagttatgagtaagaagatttttgcggccttgatagtcgctgtagtcgcaacttttgcaggctacaatatatatcagtcacagagagcagaaagtttcatgtctgatttggcgatggctaatgtggaagcattggctagagatgaggctaatagtaatggtaatacggggccaagtgagagattcgattgcccatggttattcactggtgatggatttcattgtaaatgtgaaaatatggctccatgtacagcggtcctttgtgattaacataaatataggctgtagctaagatgctacagccttattattaattttagtaagttgaaatgattcgtatgttttatagaatattagtggtctgtgtctttactatgactttattgggttgtagacataaagaaaaagtaagtgtgtttgtggcaaatgatatgaaagactcctgtttagtcagttctctttctaatactcttgatatgaattcctatgtagattctctttcttttatttcattagatgactcagatgcgaactcatttataaaagatataaataagtgtataataaaaaatgatcgtatctatattttggatttttttggaacagagtatgttaaagtatttgatttgtctggaaagtttctttttatggtaggagccaagggcggaggtcctggagagttttttcgtactttcgattttgatgtcaatgataatgggatttaccttttagatgtccgaaatagaaaaatcatagaatatgctttggacaattcatttagagaagaatatcgttatgatggtaaactgtctggaatcaatagctttttcgtaactaatcaatctaatttcgtacttggaatggataaggaaatatatgatgatgccaaagttctattagtaaatcaggaatttgaaattatccaacatatacttccttttaatgagaaagatactcaagggcaattgaagattgggagttttagaagatgtggcgataatattgttttttactaccctgtttctgatgatatttatttatttgaaaaatcgggtgagttgggtaaaaaatattctatttctttaaatgctcaacctataccagatgagattagaagtgactataataaagtagtatcagaaaggaaattaggtgggtttaattattttcatgaatctgtttattataatggtaacttatttctggctactatgttttatggttcttccaaagcgttgttttgtttggatattgtgaatcaaaagtatattataaagagttatgaaggaataatggaattatttaagaagttatcgattcgtgattttaattttcctgtgtatgcagataataaccagatagtgtgtgccatgaatcaaatgatttatgagaagatagaagagaaagagatgatagactctgcatatatagaaatgttaaaagaaggtgggactttattacttgtttatcatttaagaaatgataaaactcatgaatgacaaaatttacattctaatattaagttgtgttctatttatttcttgtggcaatagttctttaccttcaaagaatcaacaagaattatcagaaatagtcaatgaattgatggggaaacatattgtatttcctaaggtgatgtataatgatagggctattgattcattgttgaagatggattataaattggtcgtttataccgattctgtcggatgtacagagtgtcatttatcattaggagagtggtcagtgaagatccgagaaatgaaagtaataaataaaaatctatcttttgtatttattgtaaataactcaagtgaacttgttattagaagtttattgaataagaatcgatttgattatccggtgtttattgatcacaataattctttttataagttgaattctttaaaaaaagatcatcgatttcaagtctttttattggatagagaaaataatatattgcttataggagatccgatacgaaatgatgcaatatgggagttatataagaaaacgttgaatgatgaggagagtgttccatttaagcgatatagtaatagagagattgctgttagtgctaccactattaatttgggggagttctcttccgagcaatctcaatcttgtatttttactttatataatacgggtgaaaatatgcttgtcattaatgatgtggttacctcttgtgggtgtacttcagtggagtattcaaaagaaccggtttcgccagggaagtctttggatatcattgtaacttataaagcggatcatccggagcactttaataaaactattacggtatactgtaactcttccgcgtctccattgcggttaaagataatggggaatgctaaatagtttgaaatgaagagttaattgaatatatttgttgaactttaaatttgattattatgaggaaaaaacttgttttaagtgtaatgggtattctattgattttaggtactgttacaaatgtaatgtttacaagagcggagaagtcttctgatagaacctggttggcttctattgaagctttagaagctttggctgaagatgaaatagggggcagtccgggtggatgtggaactgcggtttatttttatgattgttatggagcacaaattgcagaaaatgattttacgagatcaataccttgtcaataaaaagattgcttggtaccgtatagtatcggttttattgtttcttagtgctttttcttcttgttctttgggggagaaacagaatgctccctcaaagaacgaaatatatatagctgatctggatagtgccattcagaaagattggtatttgtattctgatgtgtttaaatctgtaagagtgattcctttggcaatggataaatctgtgttgctgggagacgttaataaaatgcaggtttataaaggtcattatattgtacttgatgaagagatagcacgcggagtatatcttttcgattctaaagggcggtttatccgtaagataggtgatgtgggcagtggaccgggagaatattctaagccggcagattttacgattgatacaaaaaaaggggaaatatatatattcgattataatcaaaaaaagatatttaagtatgatattgcttcgggaaagtatttaggagtttgcaatgttgaacatcgattgaatcggatgtttttctcaaaggggtacttgtacgcaaatattgattatcaattggaagatgaacctggacaagagcattacctattacaaagaatcgactttgataatgaaggtaatgtagaaatgttttttaaagtagctgattacaaaaagggttgggacgggatagctcttcaagggaatatgttttttaatttaggaactgagtctgctctttttgttcaggactttatggatacgattatctatgtgaatggggatcaggttattccttatatggtagtgaagagtcaggattgggtgtgtaaaacagatttagaaatacttgggactactgataatccttcggccaaaggattggctatgatgaagctgattcagcatttaggggcacaaagaagggcctataatctatctgatgtgtttgtgaacgactctgttattgggttttcgtatatgcaaggaatgatggggacggatgcgttgtatgataagagtacgggtgaaactatggtgtttgatcgctctaaagatgatatgttgttcgaagagcaaccatcacacaggcagatacctacttttttgtatgcgagtgatagaggtgttttctattctcttaaacccagtcatttgcctgagatgaagtattttatctctcaaggccttgtgaaggatgaagtgattgggaaaaatgatttggattctttggatggtgatgcaaatccggtgttattgtattatgaatataaagattaagatagtattaataggactggttatcagtaacttctttcttgtatggattgttgtaatacaaagggtaaaagtatatgacggtttagataggataaatgatctaaaagaaaaagttgatagttgtggagattcattatttaattatatagatgtgaatagtgaccttacttttgatattaaacctattgatactttaaaaaatgtgcaattagtatattgtttttccgagtatatgtgtgaggaatgtgtgcgacaggatttacgtgcgttatcggatattcagaaacgaattggtgcagataggatattaatacttacggcatatgctgataatcggaataatcatattagattgagtaatttattgcgaaaatttcgatataggaatatagattattcttgtcttgtttttcctaagcataataggactggaatggaacaacgttacttttattttatagataaggaaggaaattgtaagtatcctttttatcctcttaaggaccaccttgagttgacacaatgctatttagagtttattgctaaaaagatagaatgaaaaggagtggaatatttatagcgatcggtttgttttgccttgtttcctcatgtggggatcgggacaggcaagtggaggaggccttatccctttcgggcaataatcgtaatgaacttgaagcggtgctgaagcattatgaaggagatggccggaagctggaggcggcacgcttcttgattggcaatatgcccggaagttatggagctaatccgatagtagagcaggattgttctgctttttacgaggcttatgattcattgggacaaaagtatggctatcgggtaggaacggaatgggggaaacaggtagatagtctttggaaagattttagtaatcgacatcgggtgaggcaggaacttaactatgatattacccgcatgaaggcggaagatttaatccgggaaattgatctggcatttcgggcatgggtggagaatgtgcattcaagaaactgttcgtttgaagacttttgtgagtatatactgccttataggcgacagaatggcttatcgattgacaatgcacgccgggagttcaacaaacggcatcagggaaagtattttgtgaaagagggaaaggattggcaacaagagatcgattcgttgttatacgaatataagtatctgactcattccggtttttgggggacgaagattccgatatggaatgcggcgacttttgagaagatgcgtcatgggttatgtgcacagcgctgttggtataactctttgttattatcatcgttggggattccggttgccattgactttgtcccggcatggggaaaccgaaataattcgcatacctggaatgtggtgctaatagacggggaatcgcatgcttttgaggcgttttgggataatgatcgctggaaatataagcggatttataataaccgggatgatgatgagctttggggaagattccgccttccgaaggtatacagatatacctactcaaatcatattgaaggaccgttggcagatgtagaggtggataaagctgatattccggagctatttcgtagtgtgaaaaaggtggatgtttcttcggagtattttgaaacggccgacgtaacggtggagttgacaggtgaggcgcctcaaggggtgaaatatgcttatttggctgtgttcggatatcaggactggcaccctgtgcagtgggcaaagatagaaaacgggagggctgtctttcgggaaatgggtaaggacatggtttatttacccgtttattacaagcgggggggattattgcccgtttcagattgcggaatgacggaacgatggagaagctgagcggaaatgaagaaacagaggaggttgccgtgaggatggtgacgggagcgccggcttatgatcagaatagggaatatctggggtgtatgaaaggaagccggatagtaggattacttgatggaaaatcagaagaggaactgtgcaaatggacggactcgctggctctggagccggttgtacggaaggtgtccgcacgattaccttaccgctttgtaaggttattattaccgtcggatagcattgctttgggggagctttctttttatacggaagaaggacggatcgggaatgtgaggataattactccgatgagggctaccggaaggaatgaagtgcccgggatgataaccgatggtttgggggcgacgggctatcgaggtagggtggcagaaaggctggtagatatagatctgggaaaagagtatatggtcagtcatattggaatgacttcttacctgaaaacacaattgttctgtccggatgaatttgagttaagatattggaacaatggttggaagactgtggagcgtaagcaagccgataacaaagggtatcttgtatttgagaaagtaccccggggagcattgttgatgttgaagaactgccgctggaaaggaaagacggcagagcgtatatttacttatgaaaaaggagatgtgaagtgggaatgattgctatgaacgaacagttgccttgccattattgttaaacctccttaaggaaatgcctatccgtcactttttatttgttattttgcaccaaattcgggtggagtgtgtcctgacgtttcgggggtacgcttaaatatgcagataaaaccaatgaataaactcactataaatgcctgtccgctatgtgggagcacacatttgaaatgtgctatgacctgtactgatttttatgcctccggtgaacagtttgacttgtacacctgcgaagattgcggatttacttttacacaaggagtcccggtagaggcggagataggcagatattacgaaacacctgattatatttcccattcggacacgaagaaaggtgccatgaatgctatttaccaccatgtacgtcagtatatgcttggtcgtaaggcacgtttggtcatgaaagagtcgcatcgtaaaaccggtagaatattggatattggtacgggaacaggttattttgcccatacgatgcagaataggggatgggaagtggagtccgtggaaaagagtgtgcaggcccgtgggtttgcccgcgaacatttcggattggatgtaaagccggagtctgcattgaaagggttcgttcccggttcttttgatgtgattacgctgtggcacgttatggaacatttggagcatctggatgaaacgtgggagttgttgcgcgaattattgaccgagaaaggtgtcttgatagtggctgtgcccaattgttcgtcatacgatgcaatgaaatatgggaaatattgggctgcttatgatgtaccccgtcatttatggcattttacgcctgccacgattcagcagtttgggtcgaaacatggatttatcctggcagcccgtcatccgatgccattcgatgctttttatgtgtcgatgctgactgagaaacataaagggagtgcttactcttttgcaaaaggtatgtggaccggatcggcggcttggttgagtgcccaggccaaaaaggaacgaagcagttcaatgatttatgtattcagaaagaaacgctgatgaagagtaaaagcagaaataacgctgtgtcatattttgatatgcagttcataacttccagcatcagtaccacgttggtattgctgttactggggcttgtggtgttcttcgtgttggcagccaataacttgtctgtttatgtacgcgaaaatataaatttctctgtattgatcagcgatgatatgaaagaaacggatattctgaagcttcagaaacggctgaataatgaacctttcgtgaaagagacggaatatatttcaaagaaacaagcattgaaagagcagaccgaggctatgggcaccgatccacaagagtttttagggtataatccgtttacggcctcaatagagattaaattgcattctgattatgcgaactctgacagtatcgcgaagattgagaaattgattaaaaggaataccaacatacaagatgtgttatatcagaaagatctgattgacgcggtcaatgaaaacatacgtaacatcagcttggtgctgctgggattggccattatgctgacatttatctctttcgcgctgattaataatacgatccggctggctatttattcaaaacgcttcctgattcatactatgaaactggtgggagcaagctggggatttatccgtcggccatttttgaaaagaaatatatggagtggggttttagctgcttttattgcagatacaatcctgatgggagccgcttattggcttgtgtcgtacgagccggaattaattcgggtgattacacctgaagtcatgttgttggtatcgggtgcagtactggtattcggagtggtcatcactttcttgtgtgcttatctttctattaataaatatctgagaatgaaagcaagcacgctgtactacgtgtagttccggatttatagatgtaaataaattaattgtaaataacaatgggtgataaacagaaatttgccttcgataaaacgaacttcattttgcttgccatcggcatggcagtggttatcttgggttttatcctgatgacaggaccttcatcgtcggaagcggtgtttcaggcggatattttcagtgtgagaagaattaaagtggctccggtggtttgcttcctgggttttatctttatgatatatggcgtaatgcgcaaacctaaaacaaaagaataaaacaggatggaatggtttgaagcactgatccttggattgattcagggactgactgaatatttaccggtgagcagtagcgggcatttggctattggctcggctttgtttggtatagagggagaagagaatctggcatttaccattgtagtacatgttgcaaccgtgttcagtacattggtcattctctggaaagaaatagattggatattccgtggcctgtttaagtttaagatgaacagcgaaacacgttatgtgatcaatattttaatttcgatgattcctattggtatcgtcggtgtgtttttcaaggatgaagttgaggctgttttcggttcgggattgctgattgttggctgcatgctgttgcttacggctgctttgctgtcgttctcttattatgcaaaaccacgtcagaaagagaacatctcgatgaaagacgcgtttatcattgggctggcgcaggcttgtgccgtattgccgggactgtctcgttcgggcagtacaattgctacaggtttattattaggtgataataaagcaaaactggcgcaattctccttcctgatggtgataccgcctatattgggagaagctttgctggatgctatgaagatgataaaaggtgaggctattgcgggagatattccggctttgtcactgatagtgggttttattgccgcttttgtctcagggtgcctggcttgcaagtggatgattaatattgtcaaaaaaggaaaactgatttatttcgctatttattgtgcaatagcaggagtggtcaccatcgttgtttcacaattgcaataagtaacggatgaattttaaagaaggagaagtactttattttgataaaccgttggggtggacgtcttttaaggtcgtagggcatgcccggtaccatatttgccgacggatgaaagtgaagaaattgaaggtggggcatgcaggtacactcgatccgctggcaacaggggtaatgattgtttgtacaggtaaagctaccaagagaatagaggaatttcagtatcatacaaaggaatatattgctaccattcagttgggtgccactactccatcgtacgatctggaacatgagattgatgctacctatcctacggagcatatcacccgggagttggtggaagagacgttgaaaacatttgttggtgaaatacagcaagtgcctccggcattctcggcttgcaaagtagatggtgcgcgtgcttatgatttggcccgtaaaggtcaggaagtggagttgaagcccaaattgctggtgattgacgagatagaactgctggaatgtaacttaccggaaattaagatcagggtggtatgcagcaagggaacttatatccgtgcattggcacgcgacatcggggaagccttgcaaagcggtgcacatctgaccggattgatacgtacccgtgtgggggagataaagttggagcaatgcctggatcctgcaaaatttgcagaatggatagatcagcaggaagttgagatatctgattgaaatagaaaagtaagaaataaaataattaataaacgcacattattatcatgaaactgtcgcaatttaaatttaagttacccgaagaaaagattgctttgcaccctacaaagtatagggatgaatcgcgcttgatggtactccacaagcgtacgggagagattgagcacaagatgtttaaggacatcctgaactattttgatgataaagacgtgtttgtattcaacgataccaaggtattccctgcccgtttgtacggaaataaggaaaaaaccggtgcacgtatcgaagtgttcttactgcgtgagctgaatgaagagctgcgtttgtgggacgtattggtggatccggcacgtaaaatccgtataggcaataagctttatttcggtgatgacgattcaatggtggctgaggtaattgataatactacttcacgcggacgtacgctccgttttctatatgacggtcctcatgacgaatttaaaaaagcattgtatgcgttaggtgaaactccgctgccgcatacaattcttaaccgtccggtggaagaagaagatgcagaacgtttccagtctattttcgctaaaaacgaaggagccgtgacagcacctactgcgagtctgcacttcagccgcgaattgatgaagcgcatggagataaagggcatagactttgcgtatatcacattgcatgcagggctcggtaacttccgtgacatcgacgtggaggatctgacaaagcataagatggactctgagcagatgttcgtaaccggagaagctgttaagattgtgaaccgtgccaaggatcttggtaggaatgtatgtgctgtgggaacaactgtgatgcgcgccattgaaagcacggtgagcacagacgggcatttgaaggaatatgaaggatggacgaataagtttattttcccgccgtatgattttacagtggctaatgctatggtatccaacttccacatgccactttctactctgttgatgattgtggctgcctttggtggttacgagcaggtaatggatgcatatcacatagcattgaaagaaggctaccgttttggtacttatggagatgcgatgctgattttggataagtgatgagaatatatctgggattaggtactaatttgggtgataaggagttgaatcttcgtgtcgctgtacagaaaatagaagagcggatagggaaagtgatttccctgtccgctttttatgctactgccccctggggatttcaatctgataataactttctgaatgctgcggcgggagtggagacatctctgtctcctttcgatatacttgaaaggacccaacggatagagcaggaaatagggcgtttacataaatcacatgatggggtatatagcgaccgtctgattgatattgacctcttgctttatggtgataagatattacaggacgaaaggctttcattgcctcatccattgatggccgaacgaaaatttgttttagagccgcttgccgaaatcgcaccggacgttgtccatccggtacttcataaaacaatcagagagctatttctggttctttcgtaatttacggatcatcaaatgccgtggaaggtaagccacacagccgatcaatacggcatacaatatgcgcaggtcgtcaaacggttgatggttcagataacaaataaaggcataaatacccactgtgacagcaatatacaccaatagtataatagcggtttttagtttatttttcataagatagtctgttaatacgaagcaaaagtagcaataaatccaaaatattatctacctttgcctgtgaaatgaagtgtggaaagatttgagtagcttgcaaccacagaaaaaaatgctaaaacaacattcccttctgtatgcgttttctactctttttaatttctgtccgcattcataatttataattcataattcataattttattatgggatatttattcacatccgaatcggtgtctgaaggacaccccgataaagtggccgatcaaatatcggacgctgtgcttgacaaactgttggcttacgatcccagttcgaaagtagcttgcgaaaccttagtgactaccggacaggtggtacttgcgggagaagtgaaaacaggtgcttatgttgatttacaactgatagcacgtgaagtgatccaaaagattggttacacgaaaggcgaatacatgttcgaaagtaattcgtgcggtgtattttctgccattcatgaacagagtgccgacatcaaccgtggtgtagaacgtgaggaccctatgaatcagggggcaggcgaccagggaatgatgtttggttatgcaaccaacgaaactgagaactatatgccgttgtcgcttgacctggcacatagaatacttcttgtattggccgatatccgccgggaaggtaaagaaatgacttatcttcgtccggatgcaaagagccaggtaactattgaatatgacgataacggtactcccgtgcgtattgatacaattgttgtttcaacacagcatgatgaatttgtattgccggctgatggttctgctgctgcccaactgaaggcggatgaagagatgctggcggtaatccggaaagatgtgattgaggtattgatgccgcgtgtcattgcgtctatcaatcacccgaaggttcttgccttgttcaatgataatattgtttatcacgtaaatccgaccggtaaattcgttattggcggtccgcacggagatacagggttaaccggacgtaagattattgttgatacctatggtggtaaaggggctcacggtggtggtgctttttctggtaaagatcccagtaaagtagaccgcagtgctgcttatgctgctcgtcatattgctaaaaaccttgtagctgccggtgttgccgacgaaatgttggtacaggtttcttacgctatcggggtggcgcgtccgattaatatttatgtaaatacatacggccgcagtaatgtgaaaatgagtgatggtgaaatcgccgaaaagattgatgagttgtttgacctccggccaaaggctattgaagatcgcttgaaactccgttatccgatttacagtgaaacggccgcttacggacacatggggcgtgaacctcaggtagtgactaagcatttccactctcgttatgaaggtgaccggactatggaggtagagttgtttacatgggaaaaacttgactatgtggacaaagtaaaagaagctttcggtttgtaatcagcgtagctttacagctatttattatagggggccgtacttgtttttatcccatatggggagaaaacaaggcggccttcttcttttctccttgaaatttggtacttttgcatcgtgtttaaccaaacccatgcaagaaatgaaccaaataacttccgtatgtgtatattgtgcttcaagtacgaaaatagatcagatttattttgatgcagctgtgcgattaggacagttgttggcaacccggcacatccgtttgataaatggagcgggaaatatagggttgatgcggtcggtggctgatgccgtattacagaacggaggcgaagtgaccggagtgatccctcactttatggtagagcaaggatggcatcataccggcttgacggagcttatcgaggtggacagtatgcacgaacgtaaacgactgatggctgaaaagagtgatgctgtgattgcattgcccggaggatgcgggaccctggaagagttacttgaaattatcacctggaaacagttggggctttatcttcaaccgatcgtgatattgaataccaatggctttttcgatcctttgttgacaatgctcgacaaagccatagacggtaatttcatgaggaaacagcatggagatatctggcatgtagcccatactccggaagaggctgtggatctggtttattcaatacccgtatgggacagttccatccgtaagtttgctgctatatgatttctcctcaggactctgtcggtgtgcaggtggcagatactttgccgcagaccttccatgaagcttgtgttccgaaagatacattggcggcggttgatttacagacggtgagcgagacagttacgggagtggatggcatatcgatcccttactctccaaggacggatgacgggttggcaatgatactgctgggatgtttctttatttcttcgtatgtattggcgcgcagtaagaaattcctgttgcaacaagttaaagattttatgttgcatcgtgaaagaacaagtattttcgcttcctctacggcagctgatatgcgttatctgttattgttgactgtgcagacttgtgttcttggaggtgtctgtatctttaactattttaatgatgtccggccctcactgatggagcgcgtttcgcctcatgtgctcttgggagtttatgttgctgtgtgcatattctattttttattcaagtggattatatattcgtttttgggatgggtgttttttgacaaaagtaaaacagatatatggctggagtcttattctacgctgatttactaccttggatttgctttatttccgtttgttttgtttctggtttattttgatctgaatgttacctttttagtttcaattggttgcattttggtaatttttactaaaatattgatgttttacaagtggctaaagcttttttcctgtaatatttatggggttttccttttaattttatacttttgtgcccttgaaatcataccttgtttaatagtctatcagggtctgattcagctaaataatgttttgataataaatttttaggacgttgaaaattaagaaagtattagtgtcgcagcctaagcctgcttcagagaaatctccttattacgacattgctgaaaagtatggtgtaaaaatagatttccgccccttcatcaaggttgagagcgtctctgcgaaagaattcagacaacagaaagtatcgattcttgatcatacggctgttatatttacctcacgccatgcgattgatcatttcttccatttatgtacggagttgcgtgtgacgatccctgagacgatgaagtatttttgtgtaacagaagctgttgctctttacattcagaaatatgtgcagtatcgtaagcgtaagattttcttcggagctacgggtaagattgaagatttgattccttcgattgtgaagcataaaacagagaaatatctcgttccgatgtcggatgtacataacgatgacgtgaagaatctgttggataagaataatattcagcatacggaatgcgtaatgtatcgtactgttagtaacgactttatggaaggagaggagtttgattatgacatgctggtattctttagccctgcgggagtttcttcattaaaaaagaacttccctgatttcgatcagaaggatatcaagatcggaacatttggatcgacaacagcacaggctgttcgtgatgcaggacttcgtctggatttggaagcacctaatgtgaagtctccttcaatgacggctgctctcgatttgtttattaaggaaaacaataaaggaaaataaatgaaacggtgaacagcaaacggtaaacaatgaacaggcatattcatctgtagcattgtttactgtttgttgtttgccgtttataattattatggcaaataccctgtgcaaggccgaaaggctgaatagtaagattctgattgagaagatgtttgcaggcggctctaagtcgttttccatctttccgttgcgtgtggtgtatatgcctgtggaaaatcaggatgctcaggcatctgttttattgagcgtttcgaagaagcgatttaaacgcgcggtaaagcggaatagggtgaaacgccaattgcgtgaggcgtaccggttgcataagcatctactattgcagactttaaccgataaacagcaacagttggctattgctttcatctatctttcggacgaattaacgtcctcggccgaaatagaggagaaaatgaagactctgctggctcgtatcagcgagagattggtatgaaacgtctgctttcatatatattattgcttcctatatacttttacagggcttgtatttcgcccatgacctctccttcatgtcgttttacgcctacttgttcgcagtacgctattgaagcgattaagaaacatggtccttttaaggggctttatcttgccgtcaggcggatacttcgttgtcatccgtggggtggatctgggtatgatcccgttccttagtgatttatgaatattctggatatacatacgcatcggctgcctgcagaaccggggcaggcaatacaaaattgtcagccggcagaatttattccgctggtcggtgcttactattctgtggggattcatccctggtacctgacccgtgagaatttcgtccgccagtgggaactgttgttgtcagctatccattctcctcaggttcttgcaattggcgaagcaggtctcgacaagttggcacagacggactatgtgttgcagcaagaagcatttgagaagcaggctatacttgcacacgaaatgggatatccgttagtaattcatgcagtgcggtcagcagatgaaattatccgctttaaaaggaaaatgcagccttctaacccctggattatacatggtttccgcgggaaaaaagaattggctctgcaatatatccgggagggaatttatctttcactgggagagaagtatcaggaggaagcgcttcgacagataccttcggaatacttgtttctggagacagatgaaagtctgatagatatccatagcctttatgagcgagctgctttacttctggagatgcctgtttgcaaactcatgcaacaagtacagcaaaacattaataacgtcttttttaggcaataagagttgcttgttccgataaagagtcgtacttttgccctaattaaactttaaaacttattatcattcgatgaattttgtagaagaactaagatggcgtggaatggtgcatgacatgatgcccggcacagaagagttattggcgaaagaacaggttactgcttatttgggtattgatccgacagccgattcgttgcatatcggacacttatgcggtgtgatgatcttgcgacacttccagcgttgcggccataaaccattggctttgattggtggtgcaacaggtatgattggcgatccttcgggtaagtcggcagaacgtaatctgctcgatgaagagactttacgccacaatcaggcttgtatcaagaagcagctggctaagtttttggacttcgaatctgatgttcctaatagagccgaattagtgaacaactatgattggatgaaggagttcagtttcttggattttgttcgtgaagtgggtaaacacatcactgtaaactacatgatggctaaggaatcagtaaagaagcgcctgaacggtgaagcccgtgacggattgtcgtttacagagtttacttatcagttgttgcagggttatgacttccttcacctctatgaaaccaaaggatgtaaattgcagatgggtggttccgatcagtggggaaatatcactaccggtactgagttgattcgccgtaccaatggtggtgaggcttatgcactgacatgtccgttgattaccaaagctgacggtggaaagtttggtaagacagaatccggtaatatctggttggatcctcgttatacatctccttataaattctatcagttctggctcaatgtgagtgactctgacgcagaacgttatatcaagatatttacttcgcttgataaggcagaaatcgacgggttggttgctgaacataatgaagctccgcatttgagagcacttcagaaacgtttggcaaaggaagtaactgtgatggttcattctgaagaggattataatgctgcggtagatgcatctaatatcttgtttggcaatgctacatccgatgcgttgagaaagctggacgaagacacacttctggctgtgttcgaaggtgttcctcaatttgagatttcacgtgatgcattgacagagggagtgaaagcagttgacctgttcgttgacaatgctgctgtatttgcttcaaaaggtgaaatgcgtaaactggttcagggtggcggtgtttctttgaataaagagaagttggctgcttttgatcaggtgattactactgctgatctgcttgatgaaaagtatctgttggttcagcgtggtaagaaaaactattatttgattatcgctaaataaggagttttcttttccgcctttcattcagggggcgggttgagtgaaactttaatataaaaaagaggatgtctcaaaagggggtgccatgtaataggcaaattgaccctgtgagacatcctttttctttgtggagtggcagattaatgctttcctgctttatctgccgggagttctttcagtaattcttctactgccgtcttcaattgcgtatcttcacctttgacgattgtttccggtgagttggcaactttaatgtccggctccaactgtgtgttttccagatagcttccatccgggagtcgatagcctatgacaggaataccgaataccagagatgggtcttgcaggcgttcccatgaaacactggtcatagttcccggtacgggcatacctaccaatttacccaatttctggtggctgtatacccatggtgtaccgtgcgcattcgagtaattggcttcacatgtcagcatgatagatggtttgttccatcggcggctgggcatatcgcatgcttcgcgtccgcgaacaacctgagtgaaatacttcttgccgctgaacaatacttcgatatcttcgtgaaggcggccaccaccattgaaacgggtgtctataacgataccttcgcggttattgtattttcctaaaatatccgagtagacggaacggaaactgccatcacccatcgactgtatgtgtacatatcccagacgtccgttggaccatttgtctacatcggccgcccgttgtttcacccagcgtttgtaaagcagattgttgagggttccgttgccgaccgggattactacttcttcccaccgttcaccgttttgcggattgtatagcgaaacaagcgtcttcttattggctttgtcatttagtaacgtcagataatctgtttcgggagttattgcctgcccgttgatcttttcaatgacagttccggctttcaccttcgagcgggcgtgatcgaacggccctttttcaatcacttccatgatcaatgcaccttttcctttgtgattccagtctgtaagcactcccaaactggctgtggcatctcccggaatggatggagagaagcggccgccggtatgcgatacattcagttcacccagccattcgctcagcaattcggcaaagtcgtagttgttattgatgtgcggcaggaatttgcggtaagcagcagacatggcatcccagtctactccgtgcatgttggtgttgtagaaacgtttctgctgctgcttatatacatggtcgaacatatattctcgttctgcagctaaatccattttcatctctgctttatagctgatcggcttcagagtctctccgctgaggtccattttctgcatggtgttgcctcccaggacaaacagggtttttccttcttggtccatattcatagaagcccatccggcattcattttatgaagcagcttggtctcttttttgcggagatccattttccataggtcaaatccaccttcgaatgctgacagatagtagagggtttcaccgtcttttgagatgatggtactgcccagattcgaagaattgggagtgaggcggatgatacggtcttcgagcccattcagctccactacgatgttttttacctcgtctttcttttcagtctctgctttgggatctttctttttgtcttttttcaggttagcagaagctttttctttatccttctgttgctccttttccagttctttctgcaattcataatcctctttactcagacggaacttatcgaaagcatcctgattgaggaataccagcatggcatcgttttgtgaaccccaggaagcatgtgcacgcatcccatatcgttcggtcgtgaacaagatggcattgccgtccagtgcccaacggggagatccgctcatgtaaccactgttagtcaggttgatgatcgggctgccaccctgtgcactcactaatcctatgtctgaatatggatcatgccggttaccgataaactcgagtgtgaaccattttccgtcaagtgaccattggtagtcgaaatttccgtcggtgctgaaccaagtggatccatcggtgatctggcgaacctttttcgtgtctaaattaactaccatcaagcggttgcggtcctctataaacgccagttctttaccgtccggtgagaattgcggataagcccgttccacggttgtggagggcagtaacactttttcttcgatgatagtggcattcgggaagttggcctcctctttacgggctattttagccaggaaaagttgccagttgccgttacgttcgcttgcgtaggccaaggtacggttgtccggggcgaaagtgagtccggcttcacgtgcaggtgtttgggtgatttgttttgtggtggcataatctgtcgaggtcacaaatacttctccccgtacgataaacgcaatctgttttccatccggcgatacggttcccgatgtcgctccgtttgtaaaagtcaggtctgctattttatcctgatcatcgcggacaatgtctatgtccgttttttgtggagtggcattacctttttgagtatatatttccccgtcatacgcatagcataacgttccgtcatgactcattgacaagaaacgcacaggatgtgttttgaaagatgtcaccgttttaagagactgtgtgttgtccaatgggaagttgtagacattgaacgagccttcgcgttcacttaatatatatacactctttccgtccggtgaaaggatggggttgcggtcttctccggcatgattggtcaggttggtatgttttcctgttttggtgttgtacatccagatgtcacgggtgatggacgaagtgtgatgtttccgccattcatcttcaaaacctttacggtcctgataaaggaagaattcccccgatgttgcataacaaactgcttcggccggggtgcccagcacctgttccgtacgtcctccgtttgcagggaccttgtagagctctgtcatggctgttgtcgggaacatggcgctttgtgcgggatcctggatggatgctgaaaatagaatatattttccgtccggtgtaaaagttgaagggagttcggatgcagaattggtagtcagtctttgtgccgtacctcctgtcgccggcattataaaaatgtcaaaattgccattacggtcgctggcaaaagcgatttgcttactgtccggcgaccaaatcggtgtgcattcatacgatggttgtgttgtaagctgggtggctacccctcctccggcaggtaccttgtaaatatctcctttgtaacagaatgctatttctgttccgtccggcgaaatctgtacgtcgcgcatccatagcggtgatgcggcattgccggtaagcgtggtgagacccaatgcaatgcatacaaaaagttttctcatacttactgaatttattcgtttactttattgatttctgtaagtacaaaggtagcaattagccgcggctaacgagacttattatacaaaaaagtctaaaaagatttggaaaataacttgcatggcattatctttgcatcgctttttaacagaaagcgcatgagcttgtcctatggtgtaatggtagcacaacagtttttggttctgtttgtctaagttcgaatcttggtaggacaacccccaaatgccttgaaagtaaattacttccaaggcatttttctttttgtatgaccgaatttcttttaggtcagcttgtattatccatcatctcctattcatgttatgctatttaccttaataattaattgagatggtacgttctttatctcgtcctgtgtacgcaggcttattagcccgtgtacctgtgcccattagccttggtatgcgtgcccattggcacgggtatgcgggacgagatagagccttgaccatttatataaaagatagtaaggaaaatgaaatacttttcaaggtataaatagataaggaattaactttatatgtctatataacagtagtttactatatactttctgccaaaaatggagggtggaagatggaagataagggtggaagattgatagcctaaaaagacgatcttccaccatgataaattgcggaatatcagatggtaaactacaaaaaggtggaagatggaagatggaaatactttttccgtatgagtgggtaaattggggaaaaaattttcttctttctctttctttttgcctatttttgcctattcgttaatactaaaatctaataatcaatgaaacgtcgcgattttctgaagtgttcacttgctgtaggagcaggcttggcaacctctccgttgacttatgcatttaatggtgaaaaccaagagtcaaacaatgattcgtccggctcctctaaggctcctgccacaaaaggagggaaaccacatatcatttttattatgagtgaccagcatcgtggagatgctttacattgcatggggaataaagccgtcatttctcctaacatagataagttggctcaggaaggcagcttgtttgtatgtggttatagttctgcccccagtagtacgcccgcgcgtgccggcttgcttacggggatgtctccatggcaccatgggatgttggggtatggaaaggtcgcttccaaatataaatatgaaatgccccggatgttgcgcgatttgggctactatacttttggaatagggaagatgcactggtttccacagaaagccttgcatggctttcatgctacattggtagacgagagcgggcgtagtgaaacccgtgattttattagtgactatcgggaatggtttcagttgcaggcgcccgggaagaacccggatttaacgggaatcgggtggaacaatcataatgccggaacttataaacttgaggaaagattacatcctacggcctggacggggcaaacagcctgtgaattaatacggaattatgaaagtgatcagccgctgttcctgaaagtctcttttgcccgccctcatagtccgtatgatcctccgaagcgatatttggatatgtatgaaaaggcagatatccctgtaccgtttgttggggattggtgtggaaagtatgctgaacgtaaagatccggaaaaggttgcgaaagacgcccctttcgcgaatttaggagaagaatacgctgtcaattcccgacgccattattatgcgaatgtgacgtttattgatgatcagattgggcagattattcaggccctgaaagagaaaggaatgtacgagaacgcaatcatttgttatacggccgaccacggtgatatgttgggtgaccattatcattggcggaaaacctatgcctatgaaggttcggcgaagattccttatattataaaatggccttctgccatgactacacaggctattaaaggaaaacgaatagaacagccggtagagttacgtgattttttgcctaccttcatcgaacttgcagggggaacggtaccggatgatatggacggcaagtctttggttgcactggtttcaggaaataatgatggctggcggaaatatattgatctggaacatgccacctgctatagtgccgataattattggtgtgcgcttactgacggtaaaatgaagtatatctggtttattcatacgggcgaagagcaattgttcgatttaagtgcagatcccggagaacggagaaatctttttggagacagtcgttatgcagaccggttggctgagatgcgtaaagcaatggtttgtcacttgcaagagaggggaacagattttgtaaaagatggaaagctggtagtaagagatcagaccttactttatagccctaattatccaaaagattaatgttatttatctgtgcaggataattgggcgcaatttattctcaaatcccgttttcttttcttatttttgtgtcgtgtacgcaaacgatgtttgtctgagcggcacctaatgtaaacttataaataagaaatatgaaaacaaactatgagattcgctatgctgcccatccggaagacgcaagaagctatgacaccaagagaatccggagagatttcctgatagagaaggttttttcggccgatgaagtgaatatggtatactccatgtatgatcgtatggtagtgggcggagccatgccggtaaatgaagtgttgaagttggaagctatcgatcctttgaaagctccttatttcctgacccgtcgtgaaatgggtattttcaatgtcggaggtcccggcgttgtgagagcggggaatgcgatatttcagttagcttataaagaggcgctttatttgggttcgggcgatcgggaagtaacttttgagagtgtagatgccgcacatcctgctaaattttattttaattcgctgaccgctcaccgcaattatccagataagaaagtaacgaaagccgatgcggtggttgctgaaatgggtacgttggaaggctcgaatcaccgcaatattaataagatgcttgtaaaccaggtgctacctacctgccagttgcagatgggaatgaccgaactggctccggggagtgtgtggaatacgatgcccgcacatgttcacagccgccgtatggaggcttatttctattttgaggtaccggaggagcatgccgtatgccatttcatgggtgaggttgacgaaacccgtcatgtatggatgaagggcgatcaggcagtattgtcaccggaatggtccattcattcggcagcggcaactcacagttacacttttatctggggcatggggggtgagaaccttgattatggtgaccaggatttttcgttaatcacggacttgaaataaggtgtttgatatgaatatttctttttagagaatggaagtgagatgagtttttttaaaacattataagtatggtaaacttttcattaaagggcaaagtggcatgggtcacgggtgcatcttacggtatcggttttgcgttggctactgctttctcagaggcaggcgcgaagatcgtttttaatgacatcagtcaggagctggtcgacaaggggctggctgcatataaggaactggggattgaggccagtggatatgtgtgcgacgtcacgagtgaggagcaggtaaatgctttggttgcacggatcgagaaagaggtcggagtggttgatattctggtaaataatgccggtatcattaagcgcatcccgatgtgtgagatgacagcggagcagttccggcaggtgattgacgtggacctgaatgccccgtttattgtgtcgaaagccgtgattccttcaatgattaagaaggggcatggaaaaatcatcaatatctgttcgatgatgagtgagctggggcgtgagacagtatctgcttatgccgctgccaagggcgggctgaagatgctcacccgcaacattgcgtccgagtatggtgagttcaatatccagtgcaatggcattggcccggggtatatcgccacacctcagacggcgcctttgcgtgaagtgcagccggacggttcgcgccatccgttcgactcattcattatagccaagactcctgctgcccgttggggaacaccggaagacctgatgggaccggccgtattcctggcttcggatgcttcgaatttcgtgaacggtcatgtgctttatgtagatggcggtattttggcttatatcggtaaacaacctaaatgaatctgatcaatacaattgaatcaatgaagaaagtttttctttttgccgcactcgctttgttgtgtctggcttgtaatgaagcgggtaagtcggtttctgttacggtatccaatgccacttcgctggaacgtgacggtgagatggtagaagtatccatgagcgaggtttcctctaaattgcagttatccgataccgcgcagatagtcgtggtggatgccgaagggcagcaagtaccctatcagataacttctgacgagaaagtgatatttccggtcagtgtacaggcgaatggttcgactgtttacacgataaaggcgggcattccccaggagtgtccggtgaaggcttgcggaagatattatcccgaacgggtggatgacgtggcctgggagaacgatttggtggctttccgtacttacggacctgctttacaggaaaccggagagcgtgctttcggatatgatatctggacgaagtacaacaccactgagccggtggtggaagctcgttatgaaggcgaattgaacccggatacaaaagctaaaatagcagaactcgggaagacggatcctaaagccgcgcaggagctttaccggtcggtttcttatcatgtggaccatggcaacggactggactgttataaggtcggtcctactttgggaggggggcacggctgcgttaatggcaggtgatacaattatttatccgtattgttacgctacccaggagatactggataatggtccgctgcgtttcactgtgagactggtgtatcatccgttggtggtaaggggagactccggcgtgatcgaaacacgtgtgattacgttggatgcgggttcgcatctgaacaaaacgattgtttcttataccaatctgaaagagacaatgcctctggccgtcggcattgtattgcatgaacccgatggagctgtgctggcgaatgcggcagagggatacatcacttatgtggacccgacggataatgcgggtaatgacaacggtaaaatctttgtgggtgctgcgttccctactttggtgaaggaggcgaaacctgttctgttcccggagaaagagaagaaagagctgcgcggaggtgccgacgggcatgtgctggctatcagcgagtatgaaccgggagctgactttacttattactggggagctgcctgggataaagccgatataaaagacgctgctgcctggaatgcctatatggccgattttgcccggaagatacgtaatccgctgacggtaacggtgaaataaaagagttacctgacaaataatcgatcattttgctggcgtcagcaaaatgatcgctatgtcgggaaggggttgcaggtagatgatatagcgagaacatgcggataataattgggctacgtgaaggaggcgtaaagaagactgaccagtgaagagcgaaaggctttgaagaaccggtcatagcccgacttttagtcttccatctgctttatattccttattagtccgctatacttagccctcttcacggcactgcctttgaagagggttctgtatttctcctcgcttagttgttgccagtcttctttcttcatattcataaactccggcgagggttgcagctccggtgtccggcaaggagtggcaaaccggttccagggacaagctttctggcattcgtcacatccataaacacggtttcccatcagaggggaaatagaggccggaatttcgcctttattctctatagtgaggtatgaaaggcaacggcgtgcatccaggccgtacggggcttctaaagcctgcgtggggcaggcttgcaggcagcggttacacgtcccgcagcgattcggccgggggcggtcgtatgtgtcggcttccgtgttcaggaagagttctcccaagaagaaggcagatccggcatgggggatgatcagctgggtattcttcccgatccatccgaggccggcacgccaggcccaatagcgttcgggtacgggggcggtgtcacagaacacacgtccgtccagttccggtacgtctgattcctgtatgaagcggaacagggtggtcagcttctcacgcatgaggtcgtgataatccatcccataggcataccatgcgaattggtactcgtcctcgggtaaccgggtagcggggtagtagttcagggctacggagactacgcaacgggtgccttcgaccagcagagccggatcgcagcgcttgtcgaaatggttggccatataagccatttcggcgtgcctgcccgagcccagccattccttcagaaagtcccggtgtacgggatcgaccggcccggccggtgctatgccgcaagcagaaaagccgaggcgcaaggcttcggctttcagggctttactgtttatcttcgtttccattataggatcttaaattcgtatccttcctctttcaggaagtcgatggcacggggaagtgcgtattgcaggtttccgttgttccaggacttcagcgaatcgtggaaggtaatgatggacccgttgcgggcatatctcatcacattggccagcacttgcggcgggcggagcttcttactgtagtctcgtgtgacgaggtcccacatgacgatcttatagtggcgcttcagcgtcatgtactgcatccagcgcatgtgcccgtgaggcggacggaacaggtccgttttcatcagctcgttggccttgtctgtattggccagataatttaccgacagatattcgaagccgcggatgtggttgaacgtatggttgccgatgcggtgtccgcgttccactaccatacggaacacatccggatgcttgcggatgttgtcgcctaccatgaaaaaagtagccttgatgttgtgtttgtccagcaactccagtacccagggcgtcacttccggaatggggccgtcgtcgaaggtcaggtaaactgccttctcgtcagggtccatccggaagatagcgtcgggatagattgcacggaaaaaccaaggcggttgctctataaacatcttcttcggttacagattactgatggactttcatgcgtcctacgtaaatgttatatagttcgttcactttcggagtatagttgccggccagtttcgacttgtatttctccatcattttggcttccatatccagtgcgctgaggtgcatgatgaattcacgctgcgacatcaacagatgattgtcgtccaggctgagataccaggtgaggtattccacagacttgttcgccagttcgtcgatgatctgatcggctttcgcggtatctcccaactggtagtaggcttctgccatctcgagtgccccgttctggaagtcgtagggtacgttgaaggcgggaatcatcttttcggcatattccaatgcggccagcgccttgtctttcttgccttctttcatcagctgtgtgatgagttgggcgaagatgcggcgatgggtgtagcacatgcgcattgtgttctcgtcgatgtagatgcccggcttgtcgatgcctccgaacttgaatttgttcatcaggttgtcgtacatcttctcgctgtcgatggttgcttcgagtgcttccgtatcgaacggggtgaagcggtacgtgagaccttcctggatgaaatgcccgcgcatattcagttggttgtccgtgcctacggtgatggccatgtagatggggcgttcccagttggcgttggccagcatctcgagcatcatcagctcgctcttgtagagggcgcgtttggggttgcccttttcgtctttgagcgagatgtgcatatagtcggggatggagtcgcccaacgctgccgggatcatcatacccgaacggcgtacggcttctttgtcgatcttgacaacgatgctgtcggtcggtatcaccgcttgtccgtctttggtgcgtacccagtatttcaggatattcttcagttcgtaaggattgtctccgaattgtgcccggatgttgttcagggcttccgggttcttgccgttcaggacttcttcttcggcggctttgtaggctttgtctatctgcttcttgaagtccgggcggatgggtacgtattcgttctgtccctccacgtattcggttctgtcccaggtgatgggcagtgcgggggagtcataagccgggcgtttcatctggtcgatgtaccagtcggtctgcaggtagctcaggttacaggtgcgtgcgtcggtgcggaaaccttctgtctcttggttgtaccacagcgggaaggtgtcgttgtcgccgttggtatagatgatggggttgccgctttcctgaagtgacatcaggtagttctgtccgaagtcgcgtgccacgtagcgtccgctgcggtcgtggtcgtcccatgtctggctggccatctgtatgggtacgagcaggcagactgccgacgtaagggctgctgcgggaacttctttcatgtatctgcgcaggaggtggacgatgcccgctacacccatgccgatccagatggcgaaggcgtagaaggagcctgcgtaagcgtagtcacgttcgcggggttgtcccggtgtctggttgaggtagagcacgatggctataccggtcatgaagaacaggaagaataccacccagaattgctggatgcctttctgtccgcgccatgcctgccagaagagtccgatgactcccagcagaagcgggaggcagtagaagacgttgtgtcccttgttgtccttcagttcctgtggcagaaggctttggtcgccgtacatgaggttgtcgatgaacgggatgccggtgatccagttgccgtgctctatttcgccgctgctctggatgtcgttttgtcttccggcaaagttccacatgaagtagcgccagtacatgaagttgagctggtaggagaagaagaacctgatgttgtcccactgtgtgggcatgtttaccatcagcatctctccgcattggtcgtaggggacgtcatatccggtgatgttttgccaggatttataataagcggcgtgtgccgaactgtacatgcgggggaagagcatgttctgcgcgtattcatattccacgcgtcccggaagttcgacgtacgagtctttctcgtccggtgaggttttctctttgcggacgtatttggtgtccgcacttttctggcggggaacacaatagccgtcttccacgtcgagtgctactttcgaggagtaggccgggccgtagaacaacgggcgtgtgccgtattgctcgcgtcctaagtattcgcccagcgtgaagatgtcttccggtgagttctggtccatcggcgtgttggctaccgagcggatcacgatgagggcatacgaggagtatcccaccatgatcatcatggtgcagagcagcgccgtgttcatggtgcgggcggacatgcgtatcttggcgttgagcttcgatgcgtagaagaggtagagggccagtgcgcccagtacgaggatgccgatgatgacggcgcctgctccgtgtccgtagaacgggatgccgagcatggcgatggtcagcaggaaggagaggttcatgcgggtgcggctcttctcgttgtagctttcgtagatgccccagatgatggcggctgccagcagggcgatgtagacgatcacgccggtgttgaacggcattccgagggagttgacgaacagcagttcgaaccagccgcccacttttacgacgccgggtacgatgccgtagagcaccgctgccaccagtaccatcgatccggcgagtgccagcagggagcctttagcgttggcgcccggcactttcttgtagtagtataccagtacgatggccggcaggcagagcaggttgagcaggtgcacgccgatgctgaggcctgtgagataggcgatgaggatgatccagcggtcgctgtgcggttggtcggcaacgtcttcccacttcagtatcagccagaatacgatggcggtgaacatcgaggagtaggcgtatacttctccttcgacggccgagaaccagaatgtgtcgctgaatgtataggccagtgcgcctaccagtccggaacccatgacggtgatcagttgtccgcgtgtgatggcgttctcgtccgtgatgacgagtttgcggaccaggtgcgtgatgctccagaagaggaacaggatgcaggcgccgctcatcagcgcgctcatgtagttgaccattttggctaccagtgccgggtcgttgacgaattgcgtgaaaaggttggccgtgagcatgaagaagggtgctccgggggggtgtcctacttccagtttataggcggtagtgataaattccgggcagtcccagaaactggctgtgggctctatcgtcatgcaatagacggtagcggcgatcaggaaggtgatccaacccacgaggttgtttacggttttgtactgtttcattcagactatagttagttatttgttaacatgatagacgggcgcaaagataatgatttacgtgaagatagccgtagaaagtgtagagttttaggagtttggaggggagaattaagaaacggtaacggttgttcttaaatttaagaataagaataattgaagatgaagaattatcatatgggagaatcaaaacaggagtttcaaaagacgttcgttttttgaaacacggtctttgctctgtgcgctgaatacaaaaagaagagataaatggctgataattaaaatgatgtaaaaagatttgcacagatgaaaaaagcggcttatctttgttgcatcagacgaacgtcttttgaaacacaagagccgttctatctatctaacttacacaaacttactatggaagaaagggaacgacggtgtggcggctgattgccaacacttgctggagtgacatagggtcaaaaggaaggtatctgatagcggcactgaacaaggcaaaaaggaaataaacggatagtgcaagtcctccgtatatagttgacaaaaaagcaagtatatcggatttcctccggaaaaggcttcggtgagacaggaaaacgagaaaggagattaaccaactgaaaaacagacctttcaaagcagtaaggttctgccggaaaaagctttgttttaacgcaatgttaaagcttgttctatagatgcaaataacaagtgttttaaatgcaaaaggcttgttatttgcacacaagaataagacaaaccgggaaatggcattaacaatgttaaccatcaaatgacttacactaaaaatagttgtcactacattgaggttagttactaaataagttgtcacattctattgtttcttcctaaaaaggttgttagtttaccccggttgttcctaatagagttattccttatgaaaacaatggacaactctgagtgcactcccgttctcggtgcaataaatcgtcctgactctgctcttgttgttcctgctttttcttagccataaatttaaaaattaagtgatacaataaattaaattaccgggtaaactttagcccgtcggtgcgaatgtatagggttaactaataagacattatacttccaatgatgtcggaagagaatggcggaatttggtgagtattggcgatctttttcttttatctttattatttagactatcctctttggggaaaatcacagacttcaatatccgattcttcatttattcttttgtgtttctgtgtattttatatatttttgctcaaaatctatgcttatgcccgaattcgtacagcttgacgttaaggtttttgataaatttatcaaaaagttttcagaacgatacattttgcaacgttctgaaacaaacgtagatatagattcattagacagctctcaattaaatgattgcggctttaatgtggaaaagctaaagcaagtaataaggaaaaatgctgtagccgtagatttaaaacgtgaacagggattgacacccgctattttaaacgacatttatagaagtgatttaggtgaactgttgatgacttactactttgaagagaaaataggtgaagataaacgctatgttatccctttgaaaaacatttcatcaagagagcttgctcaattgccgggacgtagtttggatgctattggttatcgcatagataatggattatttaatattttattaggagaagctaaagtttcggaacaaaaaaagactccaccagatgttgtacatgttacggaggactcaatttataaatctcaaaagaagcatcatgatgacttaccaatggtaatacaaaaattatctgattattgtcgtaaattaggtgctgaagatcttatgacttttgcctgtgctgtactttgtatggaaacaggacaaaccgataaatatactttaacttttggttgtacattaatacgggattttacttgttgtggtgaaaaagattatggtaaaatgcaaactaacgtctctgattttaatccaaatgacgttcattttgttgttttatcattcacgcaaaaaacaattagcgaaactgttgatttattttacaaagaagtacaaaagactattaaacaatgaaccgtcagattttagatagcttaatacaagatgaatcaatacgctctttattggaaaagagtgcggatgcgtattggctttctgaaatatatgattataatcttggcatatcagataacgaacaagaaattcttgttcgcttagctgttctttatacaactttatctttatctgaggagggtaaagataccaaaaatttggaatatgcttataagttactgcttgccataaaaatagaagattcgaattatctttcattatttgaaaaaatagcaggtatagatgaagtcaatagcacacttttatattattttctattatccagtattgcattaaaagatgacaacacaatatctgcgcgtataaatcttaaacaattttattcagacaatattattattacagaagattggaaaggtcgagtcctttccagaattttatatgcacttattcttcttataagaaaagataatggttttgtagatgttaagcaagcattacaagctattacggaattacaatcagagcaagaaaaattcgaggaaaattatcttcaaaattttcaatataaagaagaagtaaaggaagccttgtctcttttagcattgtatcatacttcaaaagcagttgtggaaacagcacactatctgatagacggctattcgtatcctaaacgtattgagaatgtcattcgagtccatatagacatggcagataaacttttagggaatacacaaaatcgtttaaaagatattattaaaatcatctctaacgatttgaaggccatttgtctgaattcaatttggtctcatacagcattccaagataagattagattattatgtgagaaaaaaagccaaagtggaattcttgaactgcttccttctcaacgtaatgcacttgctcaaaagttgttagatgtatatgctaatgctacaatacttcaaatgcctacaagtgccggtaaaacattattggcagaatttaatattatcgtaacaaaatccttgcgatcagacgcaaagattatatatgtagtaccttctcgtgcattagtcaatcaagtctattatgatttaaaatcagatttatcagatttaggtatttgtgtcgaaaagacatcttctgccatagaaatagaccctacggaaaatgagtttctaacttgtgacaaaatagatattttagtatctactcctgaaaagcttgatttactaatcaggagaaaacatccttccgttaatgatatttctttatttatcatagatgaggcacataccattggaaatggtcaacgtggtgcaagattagagttgctaatggctctcctgaaacgagaaagacctaatgccaaatttatgttgctttctccttttctgcatggtaaaaaaaatgtcatggctgaatggttggggggtggcaatactattcaaatagactggaaacctgcagagaagttgcttattggtttaaaaaatcataagactgaacatattgatgaaataaaatatgaattattggcatcagcttatgatacatcttttaaaagtgagacaaaaggggcttttaataatccgtataaattgcaaagtagttcggaaaaggaccgcattcttgaatttgccactaagcattttgcggaaacaggaaaaacacagctaattctttgttatggtagaggtacagccaataaaagagcaggattcatctataatctgatgaattcatttgcagaaacagaggaaattgctttagttagaaaatacattgacgatgagatagggaaagaaactaccttaacaaaatatttatcaaaaggaatagctattcatcatgccggattatcagatgaagccaaacttttaattgaatatttgatccgtgaaaaacaaataaaatatgtctgtgccactactaccatagcagaaggagtaaattttcctgtatcttctgttttctttgatgattatagaaaaggaaatactgttctctcttccaatgatttttggaatatagcaggaagagccggtagaactttagttgacaatttcgggaaaataataatgccctttcatactcctagaagtgagcaggtttttaaaggtattattcaaagaagttctgatgaattggcaagtgtattaactgaactttttattaatgaaaatagtgtgcgttcttatttgtcacaagaaagaggtatttatgacttaatcaaaaattatccggattcattttctccgttatttcagtattttgtacatttacttactactggacaaaatgcctacgcagtagaagtcgaggatatgtttaaggattcactacaatactacttgcttgaaacagaagaacaaagagataaatttgtccaattatgcaagagtatatatcaatctatagaattaaaatatagtggcaccttaggcgcattgcagtttgccgataaaacaggtttttctgttccgtctgtactgaagataatgcgtgaaaaatcacaaaatggtattatatccgatttagcaggatggcaaccgaatgtcatgttcaataaacgcgacaattctaatcttacagaaaaaattaaagtaatagctacactgaaagaaacaaatttaggaacagattctaaagaggcttctttcagtccagagctaatagcaaaaatggtaacagcttgggttaaaggagataaacttaattctatttctttaattcatcccagttataagactttgaaagatgatgaacgtatgactgaatttatgaaaaagatgaatgatatacgtttcaagacttcatggggattgagtgctttagaaggcatagtaaaaggcaatcaagatgaaattcaagattcctacatcccttcattagtttactatggagtagatagtgaaaaaccattagcattaagaatgctgggaattccacggtctttatcatttagtttagcaaatattatagatggagacttaaaagatttctcttattcttctttaagaaaaaaaatcaaaggattatcggcatctgattgggataattttaaaccgaaaaaatcaaacttgacaggagatgaatggaggagaattgttgaaattcttatgaaataaaagggtgtttcataactcaccacagattacacagatttacacaaaacattttttaatctactgataaccaataatatttatctgcgtaatctgtggtaaatacgagttttgacatatccccttgtaattagctcaacaatactccctcttaaaccaaagttcgaatacaggatcagaaaacacatacagttccccctccttctcaataaaatcacgttcggtcagcatgcgtttgttgcgggtgatggtttgtgcactttccgaacctaaccactctttcagttgtttgcgttcttctacccggttgacgaaattctctttatcgaccagtgtaccatactgaaaaggtgatttcataaaccgtttccttctttatcatagaactaaagatacaaattatacatcaatgtataatgcatcgatgtataattttaaagattatctatttcaaaaacaggcatagaagcatcatttaatggtcaccatcgtcgctccaaaaccatattcctggaaagaagcatcctgatagcggcaattactatatttacgttttagctcatcaatcaatgctttacgaagcactccgtcacctttgccatgaatgaaaactattttttgttcacgtttggttttgtacttctccatcacttcacggaatttatccaactgataattcagtatctcggcattccccatgccacgtgtgtcatccagcaactcgttgatgtgcaggtccacttcaagaatatcatttttcccgccacgttttacgatagactgcgacttgggtttatctacttctttcttctggatcaatacggattgcaattcttcggccgaaacaaatacctgacgggtaggaacatcgtctttcacaatgtcataaaccagtgccggttgttcaaagaaatcggactcacggaaagtatgaagtttatagaacttcaccgtatcgatacgcagctccacacaaaccgcaggtttcaaaggcgctgtccgtccatctttaaaagcaatgaactgaacggctacatgctccatttcattcagcatatctttagtaaactcttccagcaaaagcttcgtattgggttccaccagtccatgcgaacgggttttccaagcctttccttcggcactctgatacgtataatacaaataataattgctgtcattcaccagataggcctcgaatggagtactgctgatagctttcacatcttcgggcacataagccagaaaaacatttaaaacatcgccaccccgcacttcggccggacgaactaccggaatctcaggctttaccggtttgacgggttcttcgggtttctttggcgcaggagcagccttccgggtcatattataatcatccgtatcgatcaccacacactcacgaatctgcatcgggatatcaaatccatcagcatcttccaccaatacaatatcttttccccggaatccctttacgattcctccgcccacctcactgaggaagcgcactttatcacctattttcatcgttctgtttacaatttaccatttacaatctacaaattaaggcaaatataactacttttgtcgtcgcaaagaaagaaatgatgaaagaaaacccgaaacatatccgtattagcgaatacaattatccattgccggatgaacgcatcgctaaattcccgttgcctatgcgggaccagtctaagttacttatttaccgtcacggcgaagtcagcgaagatgtattcacctccttaccggaacacttgcctgccggaagtctgatgatattcaacaataccaaggttattcaggcacgactccatttccgcaaagagacaggagccttaatcgaagttttttgtctggaaccgattcagcctaacgactatgtactcaatttccagcaaacggaacatgcggcgtggctttgcatgatcggtaacctgaaaaaatggaaagacggtccgttacgtcgtgaaatgactgtaaaaggtttccccatcaccctgacggctactcgtggcgagtgttgtggaaccagtcattggatagatttcaactgggataatccggaagtcacctttgccgatattcttgaagtattcggtgagttacccatccctccatatctcaaccgggatacggaagaaagtgataaagagacctatcagacagtctattcaaaaataaaaggctcggtggccgctcctacggcaggtttacatttcacccctcgtgtactggatgccctgaccgaaaaagggatcgacctcgaggaactgaccctccatgttggcgccggtacttttaaaccggtaaaaagtgaagagatagaggggcacgaaatgcatacggaatatatatccgtatcacgcagtattatcaaaaagctgatagaccacgacgcttgtgccattgccgtaggaacaacttccgtacgtacccttgaaagtctctaccacatcggtgtaacgctggccaacaacccggaagctacggaagaacaattgcgtgtaaaacagtggcaaccttacgaaacggaatgtgacgtacgccctgttgtagctttacagaaaatattaggttatctcgaccgtcacggtatggaagcattgcacaccagtacacaaattattattgctccggggtacgaatacaaaatagtcaaagcaatggtcaccaattttcatcagccacagagcaccctgctattattggtctcggcatttgtcaaagggaactggcgtacaatttacgactatgcactcagccacgatttccgcttcctgagctacggcgattcatccttattaataccttaagatatgcaaagcgataataatcaggaaatgtttcccatcgtagacgaacagggaactattacaggagctgctacacgcggcgaatgccatagcggaagcaagctattgcatccggttgttcatctgcacgtattcaactcaaaaggtgaactttacttgcagaaacgccctgaatggaaggatatacagccgggcaaatgggataccgccgtaggcggacacatcgatctgggagagagtgtagaaatagctttaaagagagaggtcgccgaagaattaggtatcacggacttcacaccggaactcctgacaagttatgtctttgagtcttcccgtgaacgggagttagtctttgtgcataaaacagtatacgacggagcaatacatcccagcgatgaattagatggcggacgtttctggagctatgaagaaatcaaaacgaatttaggaaaaggtgtcttcacaccgaactttgaaagtgaaatagaaaaagcagggattttctcttctacttcccccaaagaggctgtgtagaaactcttttcgccacggagtaacacagagtagcacagagtcttttgattaataatcaacaacttaaaatcgtctctgtgttactctgtgtcctctgtggtgagttttgacacattaaatcacttcttttctatccaactgataatagtctcagaaaaaggactttctttaggagctgcgaaaccaacccaatttccattctcatcaatcataaacttctgaaaattccactgtacgggcgcatcctgcttcccgttcagtttcttctcagtcagccactgataaagtggagccatatctttaccctttaccgaaatcttggccatcatcgggaaagtaacatcataatttgccgaacagaacttggctatctcttcgttcgtacccggttcttgccccataaagttattggcaggaaaagctataatcacaaaattccgatctttatactgatcgtacaaatcctgtaactcggcatactgcggcgtcagtccgcacttggaagcgacattaaccaccaataccttcttgcctttaaggtctgccagtttatactctttgccatctatggtcttcacagagaagtcatagaacgatttactctgcgcagccatcgataatgagagtaccaagactgctacaaaagaaaaaattgctttcatattctattatttggttcatcaaataattaacaagcagcccggacagaatgtttgaaaacgttctactcctcagacatcgaataaggtttagcctccttggcaagccctctcttctcgtttggagaagcagacatttcaaattcaagtattccccctgccaagagatcggcatgggtaatatacattttatcgtaaacttttccgttgagctttacctgtcgaacatagcggttgcgatcgttcactttcggcgcttttatctcaaaagtgtttccattaggcagattcatacggatgtatggaagataaggtgctcccaacacgtattgatcggtacccggacaaacgggatagaatcccattgccgtaaacagataccaggcagacatctgcccgcaatcgtcattgccccccaggccgtcaatatcatttttgtacatccggttcatcacctcacgcacccaatattgtgttttccagggctgggaagtccatgcatacaaatagggaatatgatgactgggttcgttgccatgcacgtaccctcctaccaaactcacctcggcgatatcttcattcttttcataatatttccggggaagtgccatagagaagagtgtgtccagccggttgacaaatttcttttcaccacccatcagcccgatcaatccggttacatcatgcggcacatggaaagaaaaattccatgagtttccttcaataaaaccttcaccgtaggtctgcatagcatcaaactctttcttaaattcaccgttgctatagcgagggcgggcaaaaccgacagaagcatcaaaaacattccgataattatccgcccttttcttataaatatcggctaacggtttatctcccgccaacaaagccacccggtaaatggtccagtcgtcataagcatattccaacgtagtagatgcagccgttccactctgatcaaaaggcacatatcccaatcgtttatacgattcaatgccttcataataagacacatttgccgtatgatccatcgccggcaaagcctcccggacagatattccggcacctttgacaatcgcgtcagccaaagcagatacagcatgataaccgctcatacaccagccttcattccccatcagactccatatcggcagcatgccatgcacactctgctgctgatgccgaatcatagactgcaccatgtctctattctgccggggtttaagcaaattcaaaaaaggatgttctgcacggtacgtatcccataaggagaaaatagtataattggtaaatccttcggctgtatggatattatgatcgagcccgcgataactaccgtctacatccatatagacagacggattaatcatcgtatgatacagtgaagtataaaacatggcaagctggtcgggggttcctttggcctcaagcacatccaattcacgattccatgccgaatgtgtctcggctgccagccggctgaaagtctttccgccagcctcagcctgcaaattttttaaagccccttctgtgctcacggccgaaagagcgactttaattatcagttccggattctgccgggtatcgaagttgaaataagccaccagtttccgtccggtcatttccgggaaattccggtcggaattgaaccgtcgccagaatcctttatacaaagccttctctttatctgtatatccatagtctttgatgggttgagacaaggatatggcaaaataagtatagttggtgcgggcccacccgttcgtgatacgataccccgtcagcaatgtatcattttctacgcgtatattagcccacaacgttttcccgtcataattatagatgccgtgtaccaggtcaagaataatgcgtccgtcggcaccgtccggaaaagtatatttatgtatccctacccgttgggtagctgtcaactgtgcttttataccgtaatctgtaagctccacttcataatagcccggacgagccacttcagtttcatggctgaaacgggaacggtatccttcgtctggggtgtccgcccttccgggattcagtttcaattcacctgtagcaggcataatcaagatatctcccagatcagaatgtcccgtaccactcaagtgggtatgactgaatcctactattgtttgatcgcgatgctggtacccggcacaatattcatatgcatttttttgataaactccatccacattgtgaggaattgtatccgtatcagggctcaactgtacaagtccgaacggagcgcaggccccgggaaaggtgtgccccataccattggttccgatgatgggattgacaagtgcgcatacatccggtactgccggatgttgagccgtcactgtcgtaaatgccgggatgaatgccagcaaggaaagtgcttttttcttcataatcttattattgtgatgtgttgttgatatgcaaagatagcctttttcaacaattccgttccacttcattcccacattttaccatttcacctgccaatctttccacctcgcaatttttcatcaacaacaaaagtttcagcgatctacctttgtaccgatattcaaacacttaaggattatgtttaaagctatcgtacgtttttctataaagaagaaactattcgtaggactcactaccctctttcttcttatcggaggcatttatgcgatgatgaccttgccaattgatgccgtaccggacatcaccaacaatcaggtacaaatcgtaactgtctcgccgacacttgccccacaggaagtagagcaactgatcacaatgcccatcgaaattgccatgagcaatatcatgaatgtggaagatatccgttcggtaagtcgcttcggactatcggtagtgacagttgtatttaaagagagtgtaccgaccttggatgcccggcaactgattaacgaacagatacaatccgtagcaggagaaattccatcggaattgggtatgccggaaatgatgcccatcactaccggattgggagaaatctaccaatatatcctaaaggtagaatccggttacgaaaacaaatatgatgcgatggaactccgcacaattcaggattggatggtgaaacgccaattatccggcataccgggtattgtggaaattaacagttttggcggatacctgaaacaatatgaagtagccgttgatccggatgcgctcttttcgctgaatatcaccatcggtgaggtgttcgaagctttaagcaaaaacaatcagaacaccggaggaagctatattgagaaggctcgaaatgcttattatatccgttcagagggaatgatcagccgcactaaagacatcgagcagattgttgttgccaaccgcaacggcattcctgtgcacattagtgatgtaggtactgtccgctttggagctccaaagcggtttggcgcaatgaccaaagacggaaatggtgaatgtgtaggaggcattgcgatgatgttgaaaggagccaacgccaacgttgtgacacaagagttggaaaaaagggtggaaaaaatacagaaactattacccgaaggggtaagtatagagccttatctgaatcgttcggaacttgtcaaccgaaatatctccaccgtcatacacaacctgatagaaggtgcaattatcgtattcgtagtacttatcattttcctgggtaacgtacgtgcagggctcatcgtagcctcagttatcccactggccatgctgtttgcatttatccttatgcgtattttcggtgtgacagccaacctgatgagtctcggtgccatcgacttcggtattgtggtagacggttctattgtaatagtagaaggtatattagctcacctctacggcaataaactaaaaggccgcactttatcgaaaacagaaatggatgaagaagtggagaagggtgcttcgggggtagtacgttcggctacatttgccgttttcatcatcctgatcgtattcttccccatcctgactctgaacggaattgaaggaaaatattttactccaatggcaaagacactggtattctgcattatcggagccctattactctctctgacttatgtaccgatgatggcttccctcttcctgaaacacaccattgtggtaaaacctacgtttgccgaccgtttctttaaaaaacttaatgtcatataccaacgttgcctatgcttctgcctgcgtttcaaatggcagacagtcactatagctttcgctgctttaataggttctttcttactcttcggacgtttgggagcagaatttatccctactttggacgaaggcgattttgccatgcaaatgacattaccggccggaagttcactctctgaaagtattgaagtatccaaccaggccgaaaaggttttgatggatcaatttccggaaatcaaacatgtagttgccaaaatcggaactgccgaggttcctaccgatccaatggctgtggaagatgccgatgtgatgattgtaatgaaacccttcaaggaatggacctctgcttcgagcagggcggaaatgatagaaaagatgaaagaagccctcctgcctttagagaaccgtgcagaattcaacttctctcaacccattcagttgcgttttaacgagctgatgaccggagctaaggctgacatagcggtcaagctatacggcgaagacactcacgaactttatgcaaaagcgaaagaggctgcaaagtttgtcgaacagattccgggcgctgccgatgtcattgtcgagcaaaccatgggattaccccaactggtagtaaaatacaaccgggggaaaatagcccgttatggcattaacatcgaggaattaaacacaatgatccgtacagcttatgccggcgaagtaagcggagtagtatttgaaaacgaaagaagattcgatttggtagtacgcctcgatcaagagaaagtggcagacctgaacctcgataaactctttatccgtacttcagaaggagtacagattcctgtcagcgaagtggcaagtattgacctggtaagcggtccgctccaaattaaccggaatgccactaaacgccgcatcgtgatcggagtcaatgtgcgcgatgccgacattcaacaggtagtatcagaaatccaacaaacattggacaaaaacatccggttgaaaccgggatattattttgaatacggggggcagtttgaaaatctgcagaacgccatccgtacactgactatcgtaataccggtagccctgatgttgatcctgttgattttattcttcgctttcaagaatgtaacctatacactggtggtattctctacagtgccattatcattaataggtggtatcctggctctttggctacgcggactcccgttcagtatttcggcaggagtaggattcatcgcattgtttggggtatctgtgctcaatggaattctgatgattaaccacttcaacgacttaagaaaacaaaataaatatgccatgaccactaatcagattataaaaaaaggaacaccacacctgctacgtccggtattcctaaccgggctggtagcttcattgggtttcgtaccgatggccattgccacatccgccggagctgaagtacaacgcccactggcaactgttgtaatcggaggcttgattctatcaaccatattgaccctgattatccttccggttttttataaaatagtaaatgcgacaagtgccggttggaaacaacctaagagacggttgcatctgttcatcctgctgccggcacttctgctgagtgccaccgtcacagcacaagcgccacaaaccgtcagcctggaacaagcaataaaaatagccagacagaaccatccaaggcttaagacagccacaaccgccatccggcaggcacaggccacaagaggcgagattgtagaagcctcccctaccacattcagttactcctggggacaactgaacggcgaaaacaagaaagataaagaaatggttctcgaacaaaacctgggttcactattgacaccgttctacaagaatactcttgtcaaccgtcaagtacaaaccggcacttactaccgccaaatggtagaaaaagaagtaacggcagaagtaaaacgtgcatgggcttattatcagtatgcttcagcaatatgttcactttatcgcgaccaagatcgcatggctgctgaattaaagcgcatcagcgaactgagatacgaacaaggagaaatcaccctgttggaaaaaaacatgatggctacatcggctgcggacctgcacaaccgactctttcaggcacaagaagaagaaaaaatggctcttacccgttttcaatggagttgctacgcagatgcgcccatcataccggaaaacacgagcatgcagctcttcccgacaaatattcagccaggaagcgtatccgaagcccatctcggatttttcaacagccagatttccgaaacacgggcagcactgaacgtagagcgcagtcgtttctttccggaactcagcataggatatagccgccaaaatattctgcccctgaaaaacctaaatgcatggatggtgggggtatcatttcctatctacttcttaccacaaaagagccggatcaaacaagcaaaacttgccgcttctgccgcacaaatacaagcagaagccaatattcgcgaattgaacaataaagttactgaactgagtgccaccttacgccgtcacgaagagagtctccggttttatacctcgtctgcactcaaagaagcagacgaattaatcaaggtggctaatctacaattgcaacacagcgaaacaagcatcgcggaatttatccaatcggtcagtgccgcacgtgaaatacgcaaaggttatatcgaaacggtatatcaatataacatcgcctcactggagtatgaactttatcaataacctgttgaaacataaataatatgaaaagaatattttatcccattctcttgttggctcttatagcatgcaaagagacaaaacaaacttccgaaacagcaacaacagctccttccatcgctaaggtacaaacagatactactgctacgcaagtggatggaattacatcagccacctcaaaacccaatcaagtatctttcaacggaactatcgtactatctccccaacgccaggccaccgtagcccttaccatgggaggagtagtaagaaacacttcacttttaccgggacaacaggtgcagaaaggtaccctgctggcaacccttgagaatccggacttcatcatgttgcaacagacctaccttgacagtcatgcccaaacagaatatttgcaagcggaatatgaacgccaaaagtcactctcagccgaacaggccgcttcgcaaaaaaagtttcaacaaagcaaagcagactacttatcaatgaaaagcaaactggaagctacagctgcacaactttccttattaggtattacccctgaagaattattgaaaagtggtatacagcctctgttgcaggtgaaagctcctataagcggctatatcagcgatgtaaccatgaatataggcaaatacattcaacccggagaagcgctttgtgaggtcattgacaaatcatctcccctactctgcctgacaacttataaaaaagacctggcagatatgaaggtaggcagccccgtccaattccgggtaaacggcatgggcaaaacagtatttaaagctaccttggtctcaatcgggcagaaagtagatgaaacgagtcgttcactcgaagtatacgcccggattgacagcaccgctccacagttccgtcccggcatgtatgtaacagcaagaatacagaaataatccggtagattatcttatctttgttcccatgaaaagaatcagagctctatataacgataaataccttctgtccacggttatcatttcaatggctgtggcggtacttatccacttccccgaatccgtctccctctttgacgggtttgagagccatacccttttcccgggcatgaaatttgcagatgtagccaacgagattatcttcactttcctctcactattggccctgttcgctgtcaacacaagattgtttcatttcaatcagacctcgatgaaaatcacgtggcaaaagattgttctctcttttgtactgacttggatattgagtaacctattgggacaatgttttgtctatctgcacaaaacattcgatattcccgcaatcgatgccatggtacaccactacctgcacccattacgcgattttatcatgtcatgccttgtcaccagcagttgttacatcatctacctgatccgccgtcaacaacaagtaatcattgagaatgaacaattgcaggcagagaacatacgcaaccagttcgaagtattgaaaaaccagctgaatccacatatgctattcaattcgctcaacacgctgcgttcactcgtccgtgaaaatcaagaccgggcacaagattacattcaagaattgtcacgcgtattacgctatacattgcaaggcaacgaatctcaatctgtcaccttacgtgaagaaatggattttgtatcggcctacatctttcttttaaaaatgcgctttgaagataatctgcaattcgaaattgacatagaatgtaaccttgaagattattttctaccacctatgtcgatacagatgttaattgaaaacgctgtaaaacacaatgaaatcagtaaccgtcgtccgctcaccatcacaatcgtcaccgatccggagggcagcctctctgtaagtaaccctatccaacctaaactgacagcagccaccggtaccggcatcggactggctaacctcgacaaacgttaccatctcttgttccggcaggaaatacaaatcacagaagatagtaactttaccgttcgtatacccctcatccggaaatacccatgaaaacaattatcattgaagacgaaaaagcagcaatacggaatctgacttcactcctcaccgaagtctgtccgcaaatagaaatggtgacggaactcgacagcattgccggcaccatcgaatggtttgccagccaccctatgcctgaattgatatttatggatatccatctggcggacggttcggcatttgagatattcgaacacatccacatcacatgtcccattattttcacgactgcctacgacgaatatgctttacgggccttcaaagtcaacagtatcgattatctgctgaaacccatcggacgaaaagatgtagaacaggcactggaaaagttatctctctttagttccaacacatccggacccgctggcctggaaacagacgaactgttgaaactgatacgttcattaaaaaaacaagaaagctataaaacccatttcctgattccagtgaaaggggataaactactcccggtttcggtcgatatgatcatgttgttctatatcaaagactgccaggtgaaagctgtcctgacagataatacggaatactcctttccacagactcttgatgagttgacggaatgtctggatccggcactctttttccgcgcaaaccgacaatacctgctttcacgagaagctatcaaagatatagacctctggttcaacagccgcctctccatcaatctacgtcatccggttgcgggggaaaagattctggtgagcaaggcacgtgtagccgagtttaaagagtggttctgtgttaaataattaaggaataaaaaacaaatattaatgcaagcttgcaggatactcctgcaagccgtatctttgtaaccctaattctaaatactcaaatatggctttcaccaacaacgtaatgattgtacgccacaagttgctggcaaaactggtaaatctctggaaagagaacaaactgactaatgaaattgacagacttcccattgaactgagcccacgccgttcacgcccgctcggacgctgctgcatccacaaagagcgtgcagtgtacaaatacaagctgttcccgttgttgggcttcgacatgacagatgaaacagatgaactcactccgctttcagagtatgcccgtcacgccctggagcgtaaaaacgaacaaaaagaaaacatactctgtgtcatcgacgaggcgtgttcatcctgtgtacaggtcaattacgagataaccaacctctgtcgtggttgtgtggctcgcagttgctacatgaactgtcctaaagacgctatccgcttccggaaaaacggacaggcaaagatcgaccatgacgcctgtatcagttgtggaaaatgccatcaaagttgcccgtaccacgccatcgtattcattccggtaccctgcgaagaagcctgccctgtgaaagccatcagcaaagacgaaaacggtatcgaacacattgacgaaaacaaatgcatctactgtggcaaatgcctcaacgcttgtcctttcggggctatcttcgaaatctcacaagcctttgatgtgctcgaaggtatccgccgcggtgaaaaaatggttgcaattcccgctccttccattctcggacaattcaacacatcgatcgaggcagtatacggtgcactccgccaaatgggatttgccgatgtggtcgaagtggctcaaggagccatggataccgtaagccacgaagctgccgaactgaaagaaaagctgaaagagggacaaccattcatgacaacctcttgctgcccatcctacatcgaactggtaaacaagcatataccgggaatgaagccttatgtttcttctaccggatcaccgatgtattatgccgcccgtatcgccaaagaacgccatccggacgcaaaaatcgtattcatcggcccatgcgtagccaaacgtaaagaagcccgtcgcgacgaatgtgtagactatatactcacttttgaggaaatggcttccatcttcgaaggattggatatccagcttgaacagacacaaccgttctctgtactctacacttcagtgcgcgaagcacacggcttcgcacaagccggaggcgtgatgggagcgattcaggcatatctgggcgaagaggcaaagagattctctgccatccaggtttcagacctgaataagaaaaacataggtttactgcgtgctgctgccaaaacaggcaaagcgcaaggacaattcatcgaagtcatggcttgcgaaggcggatgtatcagtggccccagcgcccataatgacgctgtcggcggacgccggcagttgaaccaggaactgataaaacgccgcgaatcatatgaagagactcatagataaattaaaagaggaacacaccctcaccaacgaagagtttgcacacctgctatcgcattatgatgacgaaactctggcatacatcaacctgcaggcacgcgaagtggcaaacgcacactttggaaaaggggtctacatacgcggactcattgaaataagtaatcactgccggaacaattgcaaatactgtggtatccggaaagataattggcaagccgaccgataccgcctcagcaaagaaatgattctggattgctgcgaacacggctacaagctcggctttcgctcattcgttcttcagggaggagaagatccgaaacgatctgattacgacatggaggagatcatcgcggaaatccgccggtgctatccggagtgtgccattacattatccatcggcgagaaaccatcgaaagcctacgaacgctatttcatgaaaggagccaaccgctacctgttacgtcacgaaacaatcgacaggggacattactattgtctgcacccttacgaaatgtccaacgagaggcgtatcaaatgcctccacgagctgaaacgaatcggttatcagacaggaacaggtatcatggtgggcagccctcttcaaactgtagaatacttgatagaagatatccgctttattgaaagttttcatccggaaatgattggcatcggccccttcattccccatcagcgaactccattttgtgacgaaaatccgggcagcgtggaactgaccctgttactgctttccatcttcaggctgatgcacccccaggcgctgatcccttcgacaacggcattggcaagcttggcaccggatggaagagtacgtggcatccttgccggagccaatgtggtcatgcccaatctgtcacccattattgtgagaaataaatatgacctgtacgaccagaaagtagctttcggtgccgaagctgccgaaggacttgccctgctggaaaagcaactggcagatgtcggataccacatcgactacagcaggggagactataacgactaatcaataaacgatatgtataaagtagattcacctgatgccaccgacttcatcgaccatcaggaaataattgaaactctggagtatgcccgtgcgcaccgaaatgaccggaaactgattcgggaactgatagagaaagcccgcacttgcaaaggactcacccaccgggaagctgccatattgctggaatgtgttgaagaggacctgactgaagaaatatttcgtcttgccaaagaaatcaaacaaaaattctacggcaaccgcatcgtaatgtttgctccgctttacctatccaattattgtgtcaacggttgtgtatattgtccgtatcatctcaaaaacaaaactatcgcccgcaaaaaactgactcaggaagaaatacgccgggaagtgattgccctgcaagatatgggacacaaacgtctggcacttgaagccggcgaagacccggtgcgtaactccatcgactacatattggaatctatccgcaccatctacagcattcatcataaaaacggagctatccgccgggtgaacgtaaatatcgccgccacaacagtggaaaattaccgcaaactgaaggaggcgggtatcggcacctatatcctctttcaggagacatatcataaagagaactatgaacagttgcaccccacaggccccaaaagcaactatgcctaccacaccgaagccatggaccgtgccatgcaagggggaattgacgatgtgggaatgggagtcctgttcggactgaatacatatcgttacgattttgtaggcctgctgatgcacgccgaacatctggaagctgtctatggtgtgggaccacataccatcagcgttccacgtatctgttcggcagacgacatcgatgccggagacttcgagaatgctatttccgatgaaatcttccggaaaatagtagcggtcattcgcatcagcgtcccctataccggcatgatcatctctacacgcgaatcacaaaaaacccgtgaaaaagtactcgatctgggcatttcacagataagcggaggctcacggaccagcgtaggtggatatgccgaaacggaaactccggaggaaaattctgcgcagttcgatgtcagcgatacccgtacactggacgaagtagttaactggcttctgaaactcggatatattcccagtttctgtacagcctgctatcgtgcgggacgtacaggtgaccggtttatgtcacttgtcaaatcggggcaaatagccaattgctgttcacccaatgcgctgatgaccttacaggagtatctggaagattatgcttcggaagaaacgaaagtccgcggagcggccatgataaaacaagaaatgcaacacatccccaatcccaaaatccgggaaagggccttggaaaacctgaagcaaatagcagcgggagaaagggatttcagattttgaaaacaactccgctctccaaccgcctgcatattgccctgtttggtaagcgaaacagtggcaagtcgtcattgatcaatgcactgaccaatcaaaatgctgctttggtatcgaatatcgccggtaccactaccgaccctgtataccaaccgatggagatacacggcatcggcccgtgtgtattcatcgacacggccggattcgatgacaacggtgaactggggtccctgcgtatcgaacggactgtgcaagcagtggacaaaaccgacattgcactgatggtttgttgtgatacggagttatccgaagagaagcgatggatagaactgctgaaagaaaaaggcatcccctatctactgatactgaacaaagccgatctgtcagaaaacccggaagaaacagccaacgaactggaacggcagacaggagaacgtcctctgattgtcagcgccaaagagaaaacaggcatggactctatctgcaggtccatcctccaaaaactaccggaactgggcggacagccggatattgtgggcgatctggttaacaaaggcgatgtagttctactcgtcatgccacaagatattcaagctcccaaaggacggctcatcctgccacaggtacagacgctacgcgaattgctcgacaagaagtgcatcaccctgagttgcactaccgaccagttagacagtgccctgaatgttttgtcagcccctcctgcactgatcatcaccgattcacaaatctttaggaccgtatacgagaaaaagccgccacaaagccggctgacctccttttcggtattattcgcccggtacaagggagacattgactactataccgaaggagcgtatatcatagaccagctgacggaaaactcccgtgtcctgatagccgaagcctgtacccatgctcccctgtccgaagacatcggcagagtgaaacttccgcgaatgttgcgcaaacggatcggagagcaactgcatatcgatattgtttccggaaatgatttccctaaggacttgaattgctacgacctgattatccattgtggagcatgtatgttcaaccgcaaacacgttctgaaccggatagccaaagctaaaacgcaaggtgtcccgatgactaactatggggtagttatcgcatatatcaatggtattttagaacagatagataaataggctatccccaataccctaatagtattagctcagaaaaaaggttattgcaatgttacagatgcaaaagtgcaatcaaaccataacctgaaacaacagggaatttatccaaggagtccgatatattaagaatattattttatcttatatatgataaaaatcgggttttcattcgtgtttctcttttgcaattcttgtggtatagtaatttttgtatgttcttcaaacgtctctatctcgtaaggtgtcacaacctgcaccagattatttcctaaagaacgcccccataccggaaactggttataccccttactacctaccatgcctaactgcatattgatatcagctaagttggaagcacttgtctcaggaatatcacactgttccacaactgtttctccactgtgtttatccaccgaagccacataatacttcttattcaacatcatgcgcaaataaaaacgacgaggtgtctcaaaaatatcgcttacaaaaatatcgccatcagcaggaaaccttttaatatctcgaatattgagtccacgaataacctcttcatccgaattgcctaatccggccactaaaacaggctgtatggtgtctgccgacaaacgaaaaacagtatcgttactggctgttttaaacaagactgaagactgctttccacctgaaggtgaacccattactccaaatgtaaagcctgaatcttctcgaggcaccaacggcaaatagaaatcattcttggtgattatcgcctcgccatcctcttgaaatataccaataccaaaactgccaccctggaaaggcataagaggcatggcgatggcgccaatgcgcttactaccgaggtgatgagcatagatgatgggagaatttataggtaggtcttccacaaacgtgccttccaatgtatatacgccaaccttattgccgatgacgtagaaacggttatcagtctcatcagcctgtataaaacctatcataccattaaagtcatcgggaccttgaccttggcgaagaaatgtacgcaagaagtgtccttggcgatcgaacagtacaatacgagcttccttgcccaccaatacataaatatatttgcttgtgatggcaaaatcgactacaccgtctatcaatgaagcattgtcactggtcatttctaaagggatatattcgactgactctatctcatcagcaatagacaaagttgccggcgaacgaagtgcttcacgaacggaagcggttaatagacccgtttggttgacttgatttaaattacaagatgccaaaacaaatacgctaatggcaaccatgaaaaaagattttgtgttcatcatgttttaaagttatgttttggtcaaagatacaaaacatttattatgttaccatttttcccccgaatatttttctatgaaccgaaaagatatgttcaagaaaacatctctgtaattttgaaatcagacagcatagagtaataaattgtgaatgttataattggatcttataacattcacaatctatctacctaatcttcagtggaaattcctgtttcagtattgaaactcttcccctttgacatacacccgatactcctttatcataccagggtatcctttttccgcacggggcagatagcggaaaccggttacagtatagtcacctcccaaatcaataaccaactgatgcggataagcatcacgggcaacagtcatccaataagtagattcctgaagatcgaacactttatctcccgtacagttgccactacgcgtctcttcgctattggcataacgtatccgccacttttcacgcgaaatcggtttgccgtctgctcccaacacatcgagttcggcaatggctgcgaccttctttccgtcttgggccgaaagagcttcgaggcagaagaagcgtccggtatactgacgatccaaacggatctcctgccatccgttacccggagtaaacgtacctgtagcaacaggaatttcctgcttcagattcagttgttcacctttctttcgatgggtagaagcaccttcattacgcaaccaatccagtatgggtttcttcagaccgcgaacagaggctttctcaggtcccttcagatcgaggacaattatttcattttctccctctttcagccaacaaccgggcataaaaagtgtttgttgcggaccgatctcccaaaaacgtccgatagcaataccattgacccataccatacctttaccccaggtactcatatcaaggaacgtatcgccggctttatccaaatggaaagtggccttataataagcaggcattgtctgggccgttccacttttatattttttgtcttgcacaaatgagtaatcgaccgggaaattgtaagctgtccagttcttcaactccgtggtttgcttatcacagacaagttctactttctcagtgatacctttacggtcatggatggattcatcgaagttgacacgccccatagcttctaccagaatatcgatgcaggtccctttcttcaaagccggcagctgcaaagtgaattcaccacgacggcgatcgaggcgagccaatagtttaccatccgcaaaaacctgtgcccaatcgtgtacttctgtaatcttcatcgtcgtaccggcatctacaggctgctgtaaaacagtccgatacaaaatagttccccatccctgatcgaaagcttccatcggctgtatatccgtgctctgtttcgcttccggcagattggcaaagaggggagccacccgcgtaaacttcacctcgggtatctctatgaccggaaaagctacgggaacagccggtaactgttcacctgcaggcaaatagttttccagcagatcacgcagttggaaatatttatctgtagcccatcccggttcactgattggagcgtcataatcatacgaactgcacatagcagaataagcagggttgttggcacctccccaatggccgaaagtagtacccccatgtgccatataaagactgaaagagatattgcggtcgagcatatcctttatgccctgtaccatactcttggcgggacgagtctcgtgtttgcgcccccaatgatcaaaccacccactccaaaactcgctgcacatcaacggtgtgtccggacgagcctccttaagacgtttgaattgttgctcaatgttggctcccgtaccaaagttgatagtccaaagcagatcgtccagaccattccggtcgaaagtactgctccaatcacattggaaaaggggaacctcagtaaacccggcacttttcacgatgtcacgaatcgccgagacataaggtttatcaacagcataggcaccgtattcattttctacctgtaccataatgatattccctccccgggtaatttgcaaaggtgcgagctgcttgccaacttccttcataaaaatagctgtacgctccatgaagtaaggatcgagtgtacggagaacgatatctttcttcttcaatagccaccagggaagtccgcccatttcccattcggcgcagacataaggacctggacggacaataacgtacattccgtgcttctgtgccaaacggcagaaagctgctatatcattttgtccggtaaagtcaaatttaccctcagtctgctcgtgaatgttccaaaacacataaagacaaatggtattcatgcccaatgccttacacatctcgatgcgatgttcccagtaaggtgccggaatacgggtataatgcaactcggcagcctttacggtgaaaggcttgccatttaaaagaaaggtattcttcccgatcgtaaagttctgcgccgcgacaggcaacgaaaaaatcagtacgagaagtaaaatcagttttttcatgttattattgtattgttcttgggttttattgaattattattatttaagcctcatctttatttttccgaagcaaggcagcgcttcaagggttttgcaaaaattcccccatgctatttcgggataatcccagcaattgttgacatacaggatcagttggtcatccggttgtttattgatccggcatgccaccgaagcatctgtagacaaaaccgaaagctgatggatagaaggggaagctgtcgaaagagtataataatagatgttttctttcatccccttagcggtttgagtcaacgggtagcggcaattggctcctgcatctgcccaataataatagttgtgtgtatcgtctccccaaggttgaaggggttctttaccgtaagcagcctgcttcgaaatgtataaagcagtctttccttcatttccagcaaaagctttttccggataatagttccaataccctttacgtttccagtccaactgctgtatggcatctgccagatggaaagacaaacctgtttcacgcagaaatccgttgggagctccatctgtcaggtaatccacctccaactgtccatcgggagttatttttatcgaaaaatcaacagttacctccttataatttccggcaaggtcgatatatacatctccgtttgtttcctgccggtaactgaatgcacttttcttccagtcctcttccaaaatcataaaccgcgtagctgctttgcgtacttccgctcctgtcaaatgattcaggttaatatacaagttcaggaaaggtcctttttctatcagtacccggtcgccggctttggcttgtgtaatcaaccctgtctctttactgaacggtatttcaaaaccttccccacgaatgatcacccaatcaccggtttcttccaccgatagcttatttccgtcaagcacaggtggaaaaacaatcttctccgttccgagtatcggacggtaagtgtcgatcaggcttccatcggccgtccaaaattcaatcaacagatgctcaccttcttcccaccggtcagcggggatcactatgctccctttctgatggggcggaatggccggaagtgcaaaattcttcttcaccccccgataagtataactcatctgaagttcgttcaggctcgtatgatcaaagcgattataaaccggaagcaccaaacgctgtccggaagtgaagttacgaatatcatcaactaacagacgcaccggcgaatacgctttcttcgtagcccaaaattccggtttctgacgtctccatacatctacgattccccactcaccataacctacacaattaccttgatagccttcgggcttggctgtgtgggcaaactctttccagaacgaaataccggccttgggcacaggcaaagcaaaagtttcatctacatatccccaaatagctcctcccaatcctccaggcgcatcaaacagtccactccacatcatgtcaagtgattttccccagaactcacggatattcgggtcagtctgcaaagtagaataagtataacaggccggatgtgcccattcgtcaaaaagagcaggaatcccatgtccctgaaagtggcgggtattcattccccattgcgaaaggttaccgttcacatcctgatagtgcatactgagtatatcataaattttctcctttgtgtctaccgatcccggataactgaaaataacgggacgagtcgtgtctgttgccttcacccagtcccaacaaagctgaaagttagtaccatacacactctcattaccgatactccaaaacaaaatagacggatgagagcggaaactcttcaccatctcctgacactgtcccagataacggtcagtatattcgggattgctttgcgttttaccgggagcataatttttctgccgataagtatctacaaaacagacagcagtctcactctcgacatacaccccataacggtcacagtattccaggaatctttcagaaggaggatagtgcgacgtacgtacaaagttcatgttcgcttctttgaacagaagtacatcaaggctgtccaattcagcggtagtggttcgtcccagagtgggatgaatatcatgccggcaggctccgcgcaatttcacaggctgtccgttcaccaacatacgattacctgctattttaacttcacgaaatcccactttacggataaaacggctgatttctttccgatcctgcagaagtacaacagtcagggtatataaattcggatgttcagcatcccacttcaacggacgtgaaacaggcagcgaccagacctgttcttctgctcctgccttcaacggaaaacaatcctgaggaagttgtacaggttttccgtcaggagctgtcagctgcaaccggacctcagcaggttcatttccggcagatgtacaggcaaaacgaaggacagcatctcggtacaatgagtccaaatgagtctctacactaatatcgtaaagatgggtaacaggtaacgtgaacaaagtcacatcccgaagaatccctccaacagggtgatgtgcatatcccgaagcataagagatttcatccagccggtcggtcacttccaactgtatttcatttttcttccctggacgggcctgtgctgttatatcggtttcccaacgagtaaagccaccgtgatgttcgcgcaccaactgcccattgacacttaatttggcatggctgtaaactccgtcaaaacggagaataatacgttttccggcataatcggcaggaatagtaaacgatttccggtagaaaaaaggcttgtcgtgttctatggcatatccttgcatagctgcctcaccgggaactttaattgtagtccatttgctttggggtgaatatttaaattgccaggttccatttagcagtatcacaggctgtcgaactccttcctgttccacagggatagtataagcaggatacgaagaagaggtaaaaggtgcagcggtagccgacgtagcagaaaacaagaaaaatagaccaaccactatagtaaacaaagaaagtctcaatttcatgatatacgatataagagggttaattgaaggtacaaaggaacaagaaatatcatttacaaaaaatagactttatttcttaaaagatggacaatcttatgatttttaaaagattactccattataactcataaaaaaggctgcatcgttgtcaatgcagcccttttattattttttagaatctttacttagccaattcattgattacatccataatcttctgtcctatttcctcagcagcctccatagtcgatgcttcactgtatacacggataatggcttcggtattgctcttacgcaagtgtacccacttgtctgcaaagtcaatcttcacaccgtcgatatcattgatttcttcgttcttatagatttcctttaccttagcaaggatagcatctacatctatttccggagtcagatctacacgattcttagcaatgaaataaggaggataagttgcacgcaactcgctcaccttcttgccttcatgagccaaatggctaaggaataacgcgatacctaccaaagcgtcacgtccgtaatggctggcaggataaatcactccaccattaccttcacctccgatcaccgcattggttgccttcatcttggtcactacattcacttcacctactgcagaagcattgtactccataccatatttacgtgtcacatcgcgcaaagcacgtgtagagctcaaattagataccgtattacccggagtatgtttcagtacatagtcggccactgtgaccaatgtatattcttcaccatacatcacaccgttctcgcagatcatggccagacggtctacgtcagggtcaacaacaaatgcgacatctgcttttccccccttcatcaggttcatgatatcacccagattcttttccagaggttcgggattgtgggcaaaattaccggtcggttcgcaatagagtttttctacgtgtttcactcccagacgttccaacagttcaggcagaataataccccctacggagtttacgcaatcgatggctacagtgaagttagctttcttgatagcttctacatctaccaagtcaagcgccaatacactgtcgatatgttttttgttataagtaagatctttgcgataagaacccagatgatcaacatctgcataatcgaattcttcggccgcagcaatgcgaagcacttcttgtccttcggctgcattcagaaattctccgtgttcgttcagtaatttcagtgcattccactgcttgggattatgtgatgcagtcaggatgatccctccgcaagccccttccattgtcacagctaattctgttgtcggggtagaagcaaggtcgatatcaaccacgtcccagcccatacccatcaaggtaccgactacaacgttcttcaccatctcacccgagatgcgggcatcgcggcccactactatcttgttactgttcgatttgcatgtcttgcgaatcaaagtggcataagccgacgtgaattttacaatgtcaagcggattcagtccttcgcctgcgcctccgccaatggttccacggataccagagatagatttgattagagtcataggttgttgttttagaaaattggttatttagtagttttagttcaatgctttctgaaatttacgaatatcgtagaaataggggtttacatattggtttgcactctgatgtcccatcttcgaaggtacaatcattctcacatgggcataattggtaacatactttaaagcaagcagccatccgggaggaacgtctgtcgtaccatatttggcatacatcgaaccttctgtgaatacaccggccaccgaagttccattatctacgtaacggaatacatccggataagtatagtagttcggatagttttcaaaaccgggaagcaccacattgaagcaagtagtatcattggccttaatatcatgctccacgaagcgtacggctacaatattattatttttgatagaatcgttctccggtttatcggtaacaatacctttatccacaatctgcatatagactccgtttgagaaagctacatattcattcttggtcgtatccgtcttatatccgtttgcttcaaagtcactctcagaaatagtacggatatcgtgctttttaataaaagcgtttaccgcatctttctcttcatccagcatttctgcataagtcttcgaattgtcgcaagcctggaacatatatccgaaggctaacaaggaaaaaaataacaatagaagttttttcatttctgtatcttatgtatattccgtacaaatgtattttaaattagtcgaatctttagatttaaaagcagaaagttcaagtcttttaacctttgactttcaacttttaacggaagagcaaggagccatgggctataagtcaaaagtaacaagaagttatacacttgtcattccttattcataaattgtaaccgacaacccgcgacctcattgtttcagaagcggcttatatttctccaatgcctgttcaaacactttcacagcctcttccatcgtaccgtaaaactctccgcctgacgcattgagatgcccaccaccattgaaaaactcggcagctaactggttgcaaggaaacttacctacggaacgaagtgaaatcttaatcattttcttttccgtatcctcacggaggaaacaagagaaacagacattcttaatcgaaagcgggatgtttacaaacccttcgctatcgcctttgatataatcaaattttccctgttcatctttggtcagcgatataagcgcagaattgtaatctttatacacccgcatattcgataatacatatcccatcaaacgcaaacggctttcggaataagtattgtagactttccggtagatatcatctttatcgattccttttgaaagcagttcgctgataatgaaataaatctcacgattattagagttataagtgaatcctccggtatctgtcatcataccggtataaatacattcagccccctctttggaaatgtcactgaaatatcccatccggcaaatcaggcgaaacaccaattcggaagtagaagaaatttcaggatgtgaaacagtgatccgacaaaagtcttcgggatgaagatgatgatctatcattattttacgtcccggtgaggaagctactatatcagccatctcgtcaatgcgcttcaatgcattaaaatcaagacagcagataacgtctgcttccataatcaacttatcggcaaactctttataacggtcatacagcaaaatatccttgctacccggcatccatctcaggaaatcggggaaagcattagggacaattacatttacaattttatcttgagaatccagaaaatgatacaatcccaacgatgagccaatggcatctccgtcaggcgacacatgggatacgattactattttgtcggcccgttcaaaccatttagtaaaatgatcaatatgggtttgagcaattactttagtcagcataacttgtttgtataaatatgagttggcaaaaatacgataaatctttgtacttagagcaaaaacctcacagaaccttcgtcggaaagggagataaaatgcaatcccaaccgacggcattcttcactgaacactcccttataataagcggacagggaagaatccagaataacctcccggcaatgaaacagttgggccaatgactccaatcgtcctgtatagcccttacacaaatacaaataatctatgtttaacggttcagcgacagttttgttccgccaacggttatcactgaccatacaaatacgtttattaccgaacagaagcaggtggtcctgcatccagaagccggaagagcgatagtcttttgttatgggtatcggggtattcaggtgtaaccgattccaatagccggttaccgcacgcgaaagccgtctttcatccggaatgctatctgcataggcaagccaggatttaccttgagactcaatgcaatgtacaaccggacatccccggacattatagaaaacaatgctctgcaccggtcggtcagccatcctccatgcccaatgaagactacctgtaaccaacaggcaaacacctacaaggtacaaacttttcgcactacgaaccatcatatgacgcatacaggccaacaaagccagataaaaggcaagaacttccgccggataaatccaaacattatcgatagatgccaacggtagatgctctacccaacgaaccgcagcattcagtaaatcgataagaaacttcaccgccacagcacaccaggtataaagctgagaaaaagggctgaccaccagcagaataaccgctgaatacataatcaccgacacaagtggaattaccaacagattagtcaataagaaatgggtggaaaatctggaaaaatacaacaataccaaaggggctgtacctatctgcgcagcaagcgaaacacacattaatgcccagactttttttaatactccattaccaatcggaagcaacctgaacaaccggggatatatcagtagaatggcagtaacagccgaaaaagagagttgaaatccaacatcaaacagccagaaaggatgaaccgccaacataataaatgcagtcagcgcaagcgtattaagtgaaatacccgtacgcccggataagaccgacaaagccaacaatgaaaacataataaccgaacgaaccacagaaggggacagccctgtaatgaaagcaaatccccacaatgcagtaattatcactatcgcacgaaacagcctcaccccccaaacattccccggcaaccacttcagaagtaaaagaagcagcatatataaaaatccgatatgaagtccggaaagtgccagtacatgactggcccctgacacggaataagtctccctaatatcttcacctaattcctctttgtagccaacagtaagcgcggcaagtacggcaaactcatccggttcgaacttcaaagcacgatatttatccagaatccggtcccggcagtccaatgcaatctgccgaaaggaacgggacatcctgtgtccgattatctgccattttccctctgcaacaaaagcaactcctccaatccctctgtaacgtaaataacgggcataatcaaattcatcgggattaccattattggaaggtggagatacgcgcgccatcaatactaactcgtccccattatgtaaacttccggcgagtgaatctttcgaaatgtaaagcaatactttccgattcaccggtacgactcccactgagtcttgtttttctgtcagaaatgccggacagagaaaagtatgttccttctcgtcgggccgatcagtcaggatagcccgataaacgcattcttgtttttggaaagcatatacagtttgttgtaaaacctgattcatgccgccggttccggccccaaaaacaagtagataggcaacactgccgaatatccaccgaaacgaatagcgacgtgaaaaatagactgccagcagcagaaaaaataatccggcagaaactcccaccaacacggtatccggaacatacacctccttgaaaaacaaataattaccaacaagaaagcctgctatcagaggtaatagcaggcgtaaaaatggatatcgatgtaaataccggaagctcacaagccggccttacagccctttcatggcatgaatcgtctcttccggattctcagcagcaaaaatggcatttcctgctaccaacgcatccgccccggcagccaccagacgggcacctgtttccagattcactccaccatctacctcgatcagcgctttcgatccggtacgctcaatcagttcacgaagttcacgtactttctctaccgagtgctcaataaacttttgtcctccgaaaccgggattcacactcatgatcaacaccatgtatacatcccggataatgtccagcaacaaagctaccggagtggccggatttatggtaacagcaggctgcataccggcctcacggatttgttgcaccacccgatgaaggtgtggacatgcttcgtaatgtacattcataatatgcgcccccaatgcctttacttcaggaataaacttctcaggattgactatcattaaatgtacatccaacggtttctgagtcaacttagcaacatacttcagcaccggaaagccaaaggatatattcggaacaaatactccgtccataatgtcaatgtgcacccagtcggcttcactacggttaatcatctcaagatcctttgccagatatgcaaaatctgccgaaaggatagaaggggatataataggtttcatattcatcaatattttaataatagcacaaaattaacaaaaaaacatcagagctccctcttctataacagtttatttggcagaaattctttccttctattccaattccacaattgcaagtgacagactctgctttccagtacgttgcctttacactatcaaagcataagatagagagcctcaccgccaattattccgccttcatcctaaatgcctcagtcagatgaaacccacgcaaaagttcatctgtcttcagcctctttttacccggcaactgtaaagaaaggatatttacaaacccatccgacacggctactttcaggaagtgctttccatctgtaataatgctccccggagtcagtgcatgtactttctcttctttctcactctcaaagattttcactacaaccgcttcaccttccggattaagtaattcactccacgcagcaggataaggagaaagcccgcggataaaatcataaacccgtttcaccggctgattccaattaatcctacaggtttctttgaagattttcggagccggacgaagctcgccgaccactgccatttcttcctggggaattgcctttacatttccctccagaatagcatctaccgtttctatcaccagccgtccgcccaactgcatcaatttgtcatgcaccacttccacattgtccgtatcagcaataggaacgtgcacctgctggatcacctcacctgtatcgatttcatgtttcaggaaaaaagtagtaatccccgtctccgtatctccattgataaccgcccaattgataggagctgccccacggtactgcggaagcaaagaagcatgaagattgaaagttccaaaacaaggcatgttccataccacttccggcaacatccgaaaagccacaacaatctgcagatcggccttccattcgcgaagtgcctgaacaaattctgcatctttcagtttctccggctgtaataaaggcaactgatgatccagcgcatattgctttaccggagaatattggattttgtgtccacgaccggcaggtttatcaggcattgtaatcaccccgactacattatagccgccttccaccagacagcgcagggcctccactgcaaaatcaggagtccccatatatacgattcttaaatcttcttttttcatatttaaaaagctatgagttataagtttccggaaattgtaacccgtcaatcttccgagaaatgcaccaatacctggcgatacgaattaaatattttagattttgaaacaaatcccagatactttccttcttcgttgactaccggcaagttccacgcttttgtatcgtcaaacgtctgcatcacctgttccatactgtcggtatcatacaaacgggcaggaacggaagtcatcaatttactaacggtaaaacgatgataaagttcctgacggaacatgatgttccggatatcatccagcagcacgacgcctaatagaattccatccttgtctgtcacaggaaacatattacgatgggaggtcgaaatagcctttaccaattcacccaaatccatttctggacgtacacagacaaagtctgtttcgactacattttccactttcatcaatgtcagtacagccttatccttatgatgggtcagcaactgtcctttcttggccagacgcatggaataaatactgtggggttcgaacacaatgattgtcagataagaactgaccgaaacaatcatcaaaggcagaaaaaggtcatatccaccggtcagttcagcaatcagaaacacaccggtcaacggggcatgcatgaccccactcatgactcctgccattcccattagagcaaagttcttttccggtaaagtggaagtaaaatcaaaatcattgctaaagtgggagaaaacaaaaccggcaatacatcccaaatacaacgaaggagcaaaaataccaccgcatccgcctccaccgttagtcgcactcgatgcaaataccttcaacaggataatcaataccagataaaccaacagcagattgccatatccatagaacaaggagttattcaataccgtatcccaatcggcattactcgtaccgttcagcaataattcaatcgtatcgtaaccttcaccgtaaagaggcggaaaaagaaagatgagtacactcaacatcacaccacccaatgccaacttcttatacggattggacagtttaccaaataccccttctacagaactcatggcacgtgtgaaatagagtgataccaatccgcaaaagatacctaagagaatcacataaggaatacgttccaactcaaaaggctgatccaaatgaaatttaaacatagcctcttgcccggttgtaatatacgaaacagtagcagccgtaacagccgagattaacaacggcaacaaggatgacatggtaagatcaatcatcaatacttccaaagtgaataccaatcccgctatcggcgctttgaaaatacctccaatggcaccggcagcaccacatcccaccagcaacatcaacgtacggtgttccatcttgaacatacttcccagattcgatccgatagccgatccggtaagtacaataggggcctcggctcctaccgatccgccgaagccgatggtaatggcactggcaatggtcgacgaccagatattatggcgtttgatacgtccttgacgacgtgaaattgcataaaggatcttcgtaaccccatgactgatatcatcctttacgatattgcgcacaaaccatccggcaaggaaaataccgactaccggatagaccagataaaggtagttggcctctgtcgtattaaaattatctgtgagaaagttctgtatcgtatgaatgaagaacttcaggatcaatgcagcaatagctgtaaaaatacctaccagaaaacttaaaatgagaataaactgcttttctttaatcttattctcgcgccaaataataaagcgctgtaataaacttatcttttctttttccattattcgcgaataatcttaatcactccacctttatccagtttaatgatactcgatggtttaggacgactcatatcatcctgccggaaattgacaatgtagtctaccgacgattttatttcttcgctgatttcattgaaattggcagctcccggctgtccactgatattggcagatgtcgaaacaatagccttacgaaactgctggcacaaacgacgggagaatgcttcgttcgtcacccggatgcctacgctaccgtcttcggcaagcagatttgaagctaaattacgagcaccggaataaatgatagtcaatggtttatcggcaacttccatcaaatcccaagcaatcgaagggacatcctgcacataaaattcgaccttcaccggcgaatccaccaataccaacatcgccttgctgtcagcacgttgttttatctcatacacccggcgcacagcgtcttcattggtagcatcgcagccaattccccaaaccgtatcggtgggatagagaatcaccccgccttcgctcatcacttgacaagcttttttaatgtcttctatcatttcttgatctatttcttgtgagaataacgtgcaaaaatactaattttgcccaataataacaaaggttaagagaaaacaaatggaagaaatcgaatttcatcacagtttacctatacaactacgattcaatgacgtagacaagttcggacacgtcaacaacaccgtctatttttcattctacgacctcggcaaaacagaatactttgcctcggtttgtccgggtgttgactgggaaaaagatggtattgtagtagtacacattgaagccgactttctggcacagattttttcatccgaccacattgccgttcaaactgccgtctgtgagatcggaaccaaaagttttcatctgatgcaacgggttatcgataccgaaacaatggaagtgaaatgtatttgtcgctcggtcatggtgacattcgacttggagaaacatcaatccaagccactgaccgaagagtggatagaggcaatttgccgatttgaaggaagagacttgagaaagaaaaaataaataatcctccgtagatgcctttttctacggaggattttattttctccttaatataagaattccttattcacgttccccgacacactcgcatcaaaccacgaaaggttcgattgatcaagcacccatttttcataattaggatatgcctgtatgacattaattctctccttcggatacttccatgccggtgaggaggcttctttacgtgggaaatcaagtgcccagggatagcggttgtccatgcgatagtaaactccggacttaggatccgagcgatcattttctgttttgaaaagtgaaacatccgcatgctttgtcggtttataatctaccagatgaatctctttttgacggctgttgacaaagataaacggattaaatttttgagtctgcagattgctgacaggagttttcaaccgaacggttatttcagcgggagtcccggaaattccggttgccgtcccttccgtattcacatatccctcagtagtccccaaagctacatttacatcgttccacacaatgaaagtggcccattcattcccttcctcaataatagcaccttccagttttgaccggtcaataatgtcctcagaaagcggaagttcaatcccgaccccaatatgcgtccacggggctgcccccttcgcaattggtgtgaaagtcaatttcacggcagtaatagaattaccatctcctttctccagctcataagcataattcatcacaaaatcattgaaatcataatctcccatcttaggccactggtcttcaaaagcaagtgttccataaacagcctccgaaggagcgaattcatcaattaccggaatatcttcttccggtttaacggccgataccggtgatgcggtaagctttatcagcacgtcattgaaatcataatcagctttcgcatcgccataaggacggatatcaaaccccataatgcagcagttgtaatcggacatactacggatcacggcatttgtttttttagttgtattcaaagttggagtagaataatagaatccgtttacattcgcattaggaaatgtctgattctggaatttataggcgctcttcgagtttacaccgccagtagcgatattcgtaatgtttaacccgtcacgtgccacggcaaaaccgatacgtgtacccttcggaaatattgtatcatacttgtttccgtcccaatataataattgcactttcagtcccgacggacatttttcctgatgggtgttcggcaacagcaaggtcatacgatgtccctgtatatcttcgcgtttattgagttccccttctttataactatagtaagtcaaaacattgtaaacagtcctattatttacatagaatcccccatcaccaacatacgtagcccacacttctgctcccagttcgtcagtaaccaccagatccgaactcttattcagatccacatcctgtacattcttctgttccggataccaactattcacccggtttaaaaatttaggtgacaattcttcttttgaaacaagcggcgaagcatttaaaagcgggatgccgtctttcccaacttctgcatccgcatatggactatacagttcataaagattgcttagcttctggctgacaggaatcgccaactctgctccgccccgggcaacagccatgcgagtagaagcattggtactgacttgaaagggtacggcagacaagacacacgtcattcccggttgcacatcaacctcctgcacaccggaaaaaccggcagtcaatgaagttatatataccttatcgacatttaccggaacagatataatagcataaatgcatccatccacatctgtataaccaacataaagaggcttaatgacaatagtcccatcctcctcataaggttgttggggataaatccctatcaagatgccttcagcaaccttctcatccgcagaggtagccatcacaccgatctgcttatcggttctcaaagagaatttaaatgataaatccagttcttccgtatcatcaggattcttacccgacggttcatacaaatctttttcttttacacatgaggtacaaaaaagcactatcagcagtgcatacttcagcaatgatacattatttcccataagactctgtttgttcgtttgtgcgaggtcaccatatatcagtaatctcagtaatccattccactgtacaaaaatatcaaaaaaaacagaaacttacaaaatttgatcattttaatgtagattttattctcctttatcttataatatcattcacaccactatataggccctattattaatgctcttttgcattcccggttctacaggtaatataataaaatgccggcatccactcttccaaacggacaccggcatttatcattccaaccgaagctgtcagccgcctatcaaagcaatccctgccctccgatcaccccggcaatagcacttgctacagcaataatcactttcaaaataacgttccaattatttttcttcatctttttcatcctattaaaaatgcaactacgcagtcggatcatctactatgtctccatcaccacctccggaaccattattgcccgaagcaccgatcccactcgccttctgaaactcaacaccctgaaacaaagcccgggtagtaccgatagccgcaggacgagtatattcaggagtaaaatgacaaagaagggctgccacctgattcgggctcacctcttcctctttgtccactccccttccccgtgtacgcgctttcatcgtaaaagtacccaatccgtccagacgtaccgtcttactgtccagcagtgcactacgcatcgctgtcatcaagttccgaaccacattatgcacatcacccggagtcaacgacgacttttccgcaatcatctcagccaattgctgagtagataccaccttgcctaccttcaccaagttcaagtgccatttcttatcaccagacttagttgccatagtcgattttactgctttataaaataatgccatattcctaatctcctttttttaatgttattaccactgattttattcacattgcgttgatcaacattgcaaaggtgcacatttgcaggaagatgacaaaggaaaatgaggcgtccggatcaagttatacagaacaagttataatcatcacattatcagagttattacttaattctttctcatacatctacttcacatactctgctatggtccgattattcatattatatccgtttaacggaatgtccccagatttatacccgatatagtataaagttggggacgaaacaaaaatctacacccgaaaaccgggtatatctcttttctacttcgctaatctccgataagcctcttctaattttttatcgtactgattctgagcatatccggaaccattatatcttttggcaaaaccggtccagtctttccgctccagattgggccgtaacccagtaagtttaacaaacctcgcaaatgcctccagttgcttatcttctccggtacacatatctttcaccatttcatctacactgccatacccacacatcacatagttaaagcccatcacctgaaacattccccatgaagtggaagcgtcagcagcttctttatgtattttccgggccttttccagacgttcatactctcttatccctccataataatgccccttctcccatttaggataaagaatattttcattgcccgcaacatatttctccggatcaagcccctgcttcttgagttcacgccaaaagatgtgtccttcgaataaaatcatcggtcgccccggagccacaaagcccccacgaccaccggtttcaactgtctttacggcttttaccactgccactttaacgccaagccaatctgccacacgctgaaaatcattctctgttaagttttccatgagttattaatttgatttatgtaaatagaagaatctcttcataaataggaagtataatagccccaacaccaagatactccctaataaatacccatatccatactcccgcaatgccaaatatcctgctacaaccccagcttgcaccgacatataggtcaatgccactgccacgtgtggtatcttcagttcattggccatgatctgatacaaatgtttccggtgaggcaaaccaatattttcatgtagtaacaaccgatgtacgatcgtcaacacactatccaccccgtacacaacaagcaatacaagccagctgaaatccttagtttgaagaatcaaacaatgctgaggaatatggtctgacccgtgatgaactttacttcaagttgaaagagagtgacgtactcggcagaaggtatttttatccgttaataagtaagttttccacttatcgtggattggaatccgctaaaagggagaacttaccagtagcagtgaagatagcagatagtgtgatatgtctgccgatgtatcataacttgaatgaagaagatgtaactcggattgtaggattgattgtaagatgatgaaaaaataataaaattgatagtacaggtatgaatagagaaatctatgtattagggattggtcataatactcctgtgtatttggacctggtagaaagttgtggatatattattaaagatttatatcattataatgacgaaagggtgggagaattagatcatggatatcccataaaggttcttttaacgatttattctccttaaactcactatagggaatgaattttgcactaagtcaaagtggtaataaaatgagaacaactatttttgaaaaaattgtagaaaagaaagggagtgtacccactttaattcatccttctgcaaacgtttttaagtatactcaattaggacgaagagttgtagttcatatgaatacagttgttcatccggatgtaacagttggggataatacagtgttaagctataatgtttcagtgactcatagtactcatattggaaagaattgctatttagcatttggagcaatgcttggtgcttatactatagttgaagattttgtttttataggaattggtgcaattgaaattagtggaaaagttgattctataggaacctttgcatctgttggagcaggggctgtagttactaaaagtgtggcatcctataaatgtgtcgcagggaatcctgcaaagttaataaagactctgaaatgaaagaacctttagtaagtatttgttgtattacttataatcatgctccttatattcgtcaatgcttagaagggtttttgatacaaaaaaccacattcccttttgagattttgattcatgatgatgcatctacagatggaactgcagatatcatacgtgaatatgaggctagatacccgcatctaattaaaccgatatatcaagttgaaaatcaatattcaaaaggaatagaaattctttccacttataattattctcgtgcaaaaggaaaatatattgctctttgcgagggagatgattattggactgatccattgaaactgcaaaaacaagttcatattatggaaacgcatccaacattggcattatgtactcacaattttaatgttttagaaaattttgacggtaaggaaaaatttgtggatagaacaggctatacgaaagatttcttttatggtttgaaaaaatattttagatattggcctactcaaccattgacagctctttttcgaaaagactgtttaccttgtcaaaatgaggtgcaagaatattcctattatcgtgataaccatttattctattatattttaaagaagggaaaaggtttttatatatcagataagatgggggtttatcgtaagcattcaaatggaatttatgcacaattatctctattgaaaaaaattacgattgatttagattgctatattgaattatatattaaaaataaaggggatttctttttatggaagacttgtgtaaactattatgctttgttgatgtggcataagagaggtactgataacgatgaaaattactctttggagataagaaaacagattggactgattggcactgggttggcgtatttgcgtataggatatctgtttttaaagaaaagtctgtaagcacgtaagcgtccaaaaatgaagtatagggtaaactctataaaagagcgatctttgcttgcgttaaatcaaaagcaaagtttatgtatggttacaatgatttcgagcacgcaccatctggtgtcttaactaagggggtggcctaaattgagtgcttacaagataatgagtatatcaagagacatattatcagcataccgtaaactccaatataagctttgcaggcgtttagaatatggtacgatgcccccaggggagttgtgcacacatacaccttttgaggaggaaagcaatcatggagatgtggtgcatccctgtgtgcggtatgttcctgaaggttatcttggccataagtggtggatggtctatacgccttattatgctgctaacgacaagacagagaacccaatactctgttatggagacaatgggacgaacaaccctcctacgcactggatagtagcgtatcaggtgcaaggacagccagcaaaaggttacaactctgatcctacactattctatgacaatgggaaaatgtatgtcatgtggcgagagaatatgacagaaagatgcgataaagcgggatatgttcgtgctacttttggagcagaagtccttaaagacggtataggagacgtgttcggacctcttgtaggaacaaaggatgtagaagtcggcccagaaacaagccctgcttttataaaagaacaagatggcacatatcgttgtcttgccacacatatcacatttcataataagaccatcaaacggttgcctgtttttttgcggaagatcattaatcctgtaattttcatatctgatttgatgggattctggagccagcagaaggctcatggcattgctcaatggtcgtgcgacaaggtgaacggaaagtttcacttagaaggtacggtgaaatttgaagataagaatgtgctttaccgcccttggcatattgatttctttgagtgtcaaaggaagcttttcgcaatcgtacagagtaaccaatgtaatgctgatatttgtcttgcggagagtaaggatagagtacatttccgtttctttaagaagccgcttatgactaatgacacctgtggaaaagtgggaatatataagcctactgccggagttgtggatagcagattctttctctattatactgctcaggatgttgatgacagggctctcaacaaactgtatctcatcacaatggattttaatgaattgctaaagaaactgcaatgaatatagtcttttttcatggtaatggcatagtgcctacattaggaggtatttctcgtataacagatactctgggtgcattatttgttgataaaggcaataatgtatggtatattggagcgcaagacaagcataaagggcagaaatattgcagttggcagagtttcctgccgtcatctgagttgtttgctgatgagaatattagatatattattaattttataaaaaaacatcaggtagatgtaataatcaaccaatgtgcccttgaccatcgtagcgctcaatttcttgctttgtgcaaaaaagaagtagatttcctgttggtgtcatgttttcataattctattcttactccagtattgaatggagcttaccaaaaagagtatcttttaaaaacaaaaggttttggatggcttttttacttgatgaaaactcgtcttatatcgtccataatgactgcgttttatatctgtaagtatcgtaagtactacctctcaaccgtccagaatagtgatcgagttgtgttgttgtgtgacggacaacggtcagagctgtatcgaatgtgtggtattacatcttctgaaaaaatacgcgtcatccctaactgtacagatataaatattgaacagccacagtgtaaggaacagatagttgtttgggtaggtacatttgactattctgttaaacgacctgacaacatgttgcgtatatggaaacaggttgaatccaaacatccagattggaatctgttgatgttgggtgatggaccatcatggaaagagatgaaagaattgtcaaaatcgttaggtctgcaacgagtctcttttagcggtagagtgcaacctgaggtatattacaaaaagtcttcaattttgtgtgtcacaagtgtccatgaatctttttcacttgtaacgttagaggctcaacgagcaggttgtgtgcctatattaaataacgctttcagtccggctcctatgcttattcaagatggtgagaatggttatctagttccagcatttgataacaatgcttttgctaacaagcttgattcgttgatgaacaatccagtgaagagagagaaaatgagtatgagagcagtagagagtataaaacgtttttcacttgatgtggtttatgcacaatggctgaaagaactaaagaatgattaatagtgctgatttttatatccaatgcaggatccaaataaattaatctcttttgttgtcgcctttcaggtgatagctcaaggatgtaaaaatatcttagtgcaaggatttccattcttttatgagataaacgatatgttaaatgtcgtaattatgggtggttctttgctgatgtatgtgtatgccttattaacaacggggagattgcgaatacctgttcaaactatagctgttctatttttttgtgggaatgacctatttatttacttatatgtttttttctcaaaacgcaaaatatattcagcttactattcttaagacactcgtagcttgcttctttacctttctgcttgtaagcaaactgtcgacttttgaatacctttgtaattatttcaccaaaggttctttcctgataactttgagtggcgtattatatgctgggattatcagcgttataggtcatagtaccacttctgattggagtacgtattctatgactatgtcaaatgtgctactcttgtctgtactttggcagttaaatgcgtatttcgactcaaaaaataagctggcacttattgctgcaattattggttctgtggtgatatttatatatggatcaagaaatccgttcttagccattggtttctttgtttcgataaaaatattattcaattcgaaaaggaagagttcatctggagtcgccatcaaactgttctttgtttcttttgttttgattgtattatttttcttcaaagaaatacttgcttttgttggaggaatgcttgactcctttggtctgagcagtcgtaccctatattatctgataaatgcagatactgaagatattactacaggcagagctgagattcatgacaagttgtgggatatagtcctaaataatccttttttaggtttgggtgttgccggtgatgaagtggtaatacaagaactcgctcatagtatgtacctaagcattttcgttacatatggaatgatattgggtagccttgttattctttatctattttcgcaaactataaaaggtatttgtagaacatccggcctaaatcataatataattattatgtacgtctgcctcgtctttccaagaagttttacgggaggcgatatttgggcaaatgattctttatggtttttaatggcgttaatcatatcatctcttcgacaaagaaaaagagcaatggtttgatacaaatagtttataactgtgaatgttaaatcttttctgaattatgtgagtccaagactccttactagtcttcagtttctctatcatttccataggccattgaactggttcagtccaaaagatttgaacgagaaaatcaactggctgaagtttaattctgacacgagtttgtggacattgtgtgctgacaaatatcgtgtacgtaaatatattcacgagaaagggcttgatgatactcttgtgaaactgtatggtgtttgggaaaaagcagaggatgtggattgggattctcttccggattcctttgttctgaagacaaacaatggaagtggtgatatccttgtctgtaaagacaaaagcaaactggatatagaaaatacagttaggatgtattctgcattgctctcaaaatcgtttagtgagacaaatggcgagcctcactatgctgccatgaaaccttgtatgatagccgaagaagtgcttgactgcaagaaacagccgatagaaacagacacgctgatagactacaaaatttggtgttttaatggaaagcctcatcatatatgggcatgtttcaacagacatcaaggatctgtagaggtggctacctatgacttagattggaaacgacacgatgagtgtagcgtttttacttcacattataagcaagcccaatcagatttgccaaaacctgtgtcattagataaaatgcttgagattgtctcaaaactttcatgtggaatacctcaggttagagtggatttgtatgaagttgatggcaaaccatatttcggcgagatgactttctcgtcagctggtggatttatgaatttctatacatccaaatttctgcgagagatgggtgatttggtggatctgtcattggcaaaaagaaaataaagaagagatgtacgacaaaatagtttttttagttagttcactctctcaacctcgtgctatccgcagagtggaatctatagcagccctcggatatgaggtagaggtgtacggatatgatagagtgcagtataactgcaataagttttctgtgaaaataccagtgaccattttaggtcagatgtcaaaaggtaatgggtatcttgaaaagattagaaccgtaaagcgagatattgctcgtgtcgtaaaggaacacaaggggcagagttgcctttattattcctttggttacttcgagagcatcttccttcgtctgaaaggcgttccatacgcatacgagatttcggatatagcatacggatttccttcttttggtaaagcccgtcctttgcttcgggcaattgaccgtaatcttgtgaagaatgctcaatttactttgctgacatctgaaggtttcaagggtttccttaaccagccaaaggcaagatttattgttcagccaaacaaggtgaaccgtaagattattggtgtggagcgcaagccgctcaacctgaaggatgaccactttatattttcatttgtgggttcgatacgctacgcctcaatgatgcgttttgctcgaaccataggaaagtatttccctcagcatgagtttcacttccatggggtggcaaatgtggaatcgacccagaaagctattgatgatatgatggaattgtacccgaatatcaaattgtttggtgctttcaaaaatcctgatgatttcgaacatatttataattctgtagatgttgtggtggtgacatatggagtagaatcgctcaacgaaactattttggatccaaacaaattgtatgagggcatctttttctgtcgtccgctgattgctactaaggggacttttcttgctgaacagatagaaagttatggttgtggtgtcagcatagactcgtcgacagaagaggcaatacgtgattcgctcagactgttgacaatagagcaacttaacaatatttctagaaaggaatatgaaatagagcgagaagagatttttgacagtatggataatctttcaacattacttgaggagatatgcaagaaaagaaagaattgaattgggtaaatgtggcaaaagcaataagtattatcactgtgctgtttgtgcatacagaaaactattacggtctggaattcggcgaaatcaatcaattcttgtgcggattctatgtaaatgctttcttcttgattagcgggtattgtaaaaatattttatcctcaggcgtccctttgggggttatttttaatatttggccttacattaattggggcgtatatagcaagcttggttattgtgaaatatctgctatggatgcttgatattaggaaattaagaaaatgatgaaaaaaattgttcttgtgaatcaaacatctggtttccttgtggtggatgacttgaatgcatattgcgcgaaatatgacagtgtaagtgtgttgtgtagtagtcttcgcccggggatgagacctgtcaatccgaagatcaatattgataaaatctgtaactacgataggtcaagtagcacaaagagaatggcgacttggctgttggcatccatgcaggtattcttcaagttactcttcaagtataaagattgtgaagtagtctattataccaatccgccaatggcttgcttctcagccttactcttgaataacaagtttcgtattgtggagtatgacatctatcctgatgctctcaagataattggtataagtgaaaaaaactttatttataaaatatgggtaatactgaaaaaacgcctctataaaaaggcagagaagatatatactttgagcgaagggatgaaggaggttctgacagcctatgggtcaactgaaaaaataaaaattgtgccgctatggtcggtttctgatgatttcaaacctgtggctaaggaggctaatgtcttcatcaagcagaacaatcttgatgggaagttcatcgttatgtattctggaaacatcggttatacccatagtgtagagtgtgtcgtggatgtagccaaggagatgatagatgatatagatgtgcagttcctgattattggagacgggaagaagaaagccgaactgatggagaatgtggatcattcgaatctgcagaatgtacgctttatgccgtttcaagattttagtatgttaccatactcattggcctcggctgatctaggggtggtcactttggatgagaacgtttctaaagtgagtgtgccaagcaagactttcaacctcttggctgtgggtgctcctcttttggcaatctcgaatgatgacactgaaatgtacaggttaattaacaaatatggctgtggccgttgtattccaaagaaagatattgaaaaaatggtgctatatattaggaagttgcgtgatgacaaggaatacaaaactcaactctgtaacaattctgtaaaagcaagtcaagatttcacatataagaatacagaaatgtattttgaggattaatcttttaaaatagtagttattgtccaaaaatgacatattgcttatccattgcaaacatgcgaattttactttcgttaaatcaagaagcgaagtttatgtatagttgtaatgactttgagcgtcttttttgcgctacaaattagaaggtactccctcgggaatctccatagagcaattctgtttgtccaacaaagtatcttatagcctgtttgaaaaatggtacaaggatacccgaaaaaagatagtatcagtccaagtcttgggtactcttccaacaaagttggattcagtggaaacctctacatcggctttgaatcaatctccgaaagatgattcctcggttcttccgcatgccggacttcgtatcttggtaaatatccgcatgaataacggtgttaatgtcaaagaatgtatacgctgtggatgtttgttacccttggctatcggagtggattaataacaagtattaaaaatcagtatgttttttgatgttatttattggggagtcaccttgtgtggctttccttaggctatacgtcgaaattggatgctaactaaattctggctatatgtattgtttttttttgaaacgtgtaattgatttttgtcttgttttttgcgctttggtgatttgttgtcctgtacttttcattatagctctttggctttattttgccaataaaggtgccggtgctttttttcttcaggagaggcccgggcggcatggtaagatctttaaggtcatcaaatttaaaaccatgacagatgaacgtgatgcagaagggaacttacttccggatgataaacgattaacgaaggttggtaagtttgttcgttctacttcgattgacgagcttccacagttgattaatgttttgaagggtgatatgtcctttattggtccccgtccgttgttacctcaatatcttcctttatacaataaagaacaggctcgtcgacatgaagtccgtcccgggataaccggttgggctcaggtaaatgggcgtaatgctatttcatggacaaggaaatttgagttggatgtgtggtacgtagatcattgttcgtttttacttgatttaaaaattatctttttaacaataaaaaaagtttttgtacgtgaaggaatcagttctgatacttgttcaacgatggaagcttttaatggaaataattaagaaatgaagaatatagcaatttatggagccggaggttttggccgtgaagtctcatgtatgcttaatattattaaccaatgtgagtcaagatggaatctaattggttttttcgatgatacaaagcctataggctattcttgcggatatggaaaagtacttggagggcttgaggttttaaatatgtatgatgagccgttagatgtaattattgctattgcttctcctgttggagttcataaattagtgggtgaaataaagaatccatatattgactttcccaatatcatagctcctgatgtgcgttttacagatcaaaattctctgtccttagggaaaggaaatattttttgttggggatgttgtgttacttgtgatataacgattggagattttaattcttttaatggttttattactatcggtcacgactcaagaataggaaattataatgtttttatgcctaaagtacatgtttctggtggaacggtaatcaatgatgagaattatataggaacaggagctataatattacaaaaaaatcgaataggatatagaacagttgtcggagctaacagtgtaatcattcgtaatactaaagatgattctacctatgttggtaatcctgcaactattgtcaaattttaaaataataataaaatggaacttaaaacatttattgaaaattttgcagctcagtttgatgaaacagatgaatctgtatttggtgcggaaaccgtttttaaagaattagaagaatggagttcattgattgcattatctgttattgcaatgatagatgaggaatatgatgtacgtattaaaggagaagatatacgtagtgcccatacaattcaggatttgtataatgttgtaagaacaaaggaataatggcttttatagatatatctaatgttgtagttaaaggtttttctgcatgcgtgcctccggatattgatgaaaatattaattactccttattaacggaagaagaaagggcgaaggtaatatcttcgattggagttgaacggaaaagggtagctaaagataatgtttctgcttctgatttatgttataaggcggcagaaaagttaatcgaagaactacattgggataaaaatgatattggatgtctgatatttgtatcccaaacccctgactatatattaccggctacatcttgccttcttcagcaccggttaggccttaactctgagtgttataccctagatatatcattaggatgttctggatgggtatatggtttgagtgtactttcttcattgctttctcatggaaatataaaaaagggactattattagtgggggatataactacacgattgggatgccgtgaagatacgagttattggccattgttcggggatgcaggaactgctactgctgtagaatatgtagaaggtgcttccggtatgtatttccacacggctacggatggcagtggagcagaagctataattatcccagacggagcatatcgaaatggaatttcgaaggaaagtcttaaaatagaagtcgatactgatggtttgaatcgatctaaactgaacactaaaatggatggtatggacgtttttgcttttgctgtttcgaaagcaccaaaaagtgttgtcgccttgttagaaaaattacaaataccccaagaggatatcgattgttttgtatttcatcaggcgaatagatttttaaatgagaaaattaggaaaaagttaaagatagatgcgtctaaagtaccttactccttgctgaattatggaaatacaagctgtgctactattcctttgactttagttactgaaagacaagaacagttacaaaattctcgaatgaatatcgtaggatgtgcatttggagtagggctttcgtggggaagtgtctacttttctactgaaaacattatttgtttagatttaatagaatattagtctttatggaaatatataatcctttttctttgatagggaaaactattttagtaacgggagcttcttccggtattgggcgttcaattgctattgaggcctctaagatgggggctacgttaataattacaggacgtgataaagagcgtttgaatgaaacttatacctccttaatggggaataatcatttacagtttattgctgatttaaatgaatcggaagctgtagataatttggttgattctttaccgagtataaatggggttgttcttgcgctaggtattggggattggcttccgtttcaatttgtaaaaaaggaaagactgtaccgcatctttgaaacaaacttttttgctcccgtcattttaattcagaaattattaaagggaagaaaagtacggaagggctcgtcaatcgtttttttatcctctattgatggtccggttacagcacatataggaaattcaatgtatgctgcttctaaaggggctgtgtctgcaatggttaagggcatggctgttgatttggcttcaaaagaaattcgtgtaaatgctcttttgccaggaatgattgaaacacctttgattcattgcggcgatataacagaagaacaattgaaagaggataaaaagttgtatcccttaaaacgttatgggaaacctgaagagatagcatatgctgcaatatatttactgtctaatgcaagttcttttactacaggggcaaacttggtaatagatggaggatttactttattataataaatggctacaataacatatcataacgtaggtgtgaaagcaatggcagcttgtgttccttcaccggttgcctacaataaagatctggcttgtttaatgagtcaggaggaagttgataaaatgattaattctgtcggtattcatgaacgcaggattagtccggtggatgtatgtgcatctgatttatgctataaggcagcattaaaattgatggaggataatcagattgatccggaatcaatcgatgtgcttttgtttgtgagtcaaacatccgactatcgtattcctgctacttcttgtgttcttcaacatcgtttaggtttgtctaaggcatgtgcatgtttggatttgactttgggatgttcaggctatgtttatgcgttgtctacagcatatgcttatgcttcgatggaaggtgtaaacagagtattgctacttgacggcgaaactttttctaaaatagtgaatcctcgagataaagtcaatgtacctttatatggtgatgcgggaacagccaccttggtagagaaaggagcttataaggattctgtatttatcttaaatacagatggaactggggcagatgcagtaaaaatacatggtggaatgcgtcatcctattacgtctgattcctgtttggaaaaagaacgtgaagatggtaactatcgtacggatatggaaatctttatggatgggatggatgtattcaattttgctataagtgtagtgcccaaaggagtaaaagaggtcatgaaaataactgattcctctttagaggatattgattatctggtttttcatcaatctaataaatttatgactgatttctttgtaaaaagattgaagtttgatgaaactaaagtgccctattgtattgctaagtatggaaatacaagttcagcctctgtacctttaactatcgtttctgaactctgggagaagctgaatgaagaaaaagtagtagtgatgtgtggttttggtgccggattgtcgtgggcaactgcacgcattgtttataacgaatgtcatatatcacctataatagaatattgagttatgcttcctgattttaaatttcatcatattggaatagctgtctttgatatagatgatactgcacagtattatatagatgcagggtatcagaaaacagaaactgtaattgatgcaatacagaatgtgaaaatctgttttctgacgaaagaaggtatgccgatgttagaactgttggcacctgtagatgaaaattctccggtaaaccgaacgttggataaaatgggagtaactccttatcattgttgctattcggtagatgatatggaaggggctattgctcgtttaaagaaaataaagtttgtgccacttatcaaggctgtggaagcatgtgctattggtggaaggcgtgtttgtttcttatttaataagaaagttggtttaatagagttagtagagtcttaatactgctgttatgaagtattttatttttcgtaataacactttagagaatctgtttggcacgacagatgtaggatattccggttatgatgacatttcatatgtccctttggaagtagattcttatgtgtggttttatcaggttcctataaaatttgacattgattctttgacagaagaagtaaatggatactttgataagttgcagattgtttataaacaacttcctgctcacagtcagctgatcgttttttctttggagaatctttataatttgaatttttgtagtacaaattatgagctcaaaaattcgattataagatttaatatggatattcgtgatttttgcaatacatatgcaaatgtaaaattcattgatttttctgaattcttatcggattaccccaaagaccaatggatcgattggaaatattattttctttcccagatggtgattaatcctaagttggcaggggcttttcgcaaatggttcacttgtaaaacaagagagcttgctttaagcaggaaaaaatgtttggttctcgatttggataatacactttggagtggtgtactgggtgaggacggtattggaggtattggtatcggaggagattaccccggaaaggcttttctttattttcaggaagctttgattgaattaagcaaacaaggggttatcttgacggtttgcagcaaaaataatgaagcagatgtgctggaagcatggaaaaagaatccgtttataaaacttaatcagaaatatctctctgcttatcgaatcaattggcagaacaaagctgataatataaaagaattggctcaggaattgaatatcggtctggatagttttgtttttgttgatgataatcccacagaacgagaattggtgaagcaacttttgccgatggtggaagttcctgattttccgaagcatccttatctgttgccggcattctttttcaacttggttgaacgttatttccgagtctatgccattacggaagaggataagaaaaagacggaacaatataaagcgaacgttagcaggacacaggaaaaaaagaaatttacagatcttggtgcctacctggcaagccttgaaattgaggttacggtaacgggagcaaacgaatttaatattcctcgtattgcacagatgactcagaaaacaaatcagtttaatctgacaactaaacgttatactgatgtggaaattcgtagtcttatagaaaaaggatggtctgtcttttgtattagtgtaaaagataaattcggagataatggtatcaccggagctataattttagaacctcttgctgatggaatgagaattgattcattgctgttaagctgtaggatcttaggtaaaggaattgagttagcttttgtacgttttattttaaatcgcttgcacagctatggagttggcaagatatatgctgactattatccgacattaaaaaatgcccaagtagctgacttttacgatagggtagggtttgatttgtcagatcagaaagaggatgggacaaaagcatatgtacaatgtttgtcgggtaattatcaaatagaatcttattataaaataaatatgaactgatatggaagagaaaatattggagatactgaaactggtatttgagctggagaatgtggatgaaagttgcgcccaggtgaattgtgaaaaatgggactctttgaagcatttggaattagtggttgagattgaatcggcatttaatgtagagctggaacctgaagagattgccgaaatgaaaagttttaaggacattaaaaggatacttcaggggaaatagatggaggttgttcgttttgtaaattcagtttttgaatctaacacttaccttattaaagatgattgccagagtcaatgctatttagttgattgtggtgatccggaacctatattagaagagttgcagcgctttgatttagaacttgcggctatttttatcactcattcacattttgaccatatttatggattgaatgaagtggtatctaatattcccttcgttaaagtgtatctttcattacatggaaaagaaggactgttttccgaccgattgaatatgtccagataccattctacttcttttatatatgaatatgatgataatattgaagtagtagaaaacaattgtatcatatctttatttggtagagacgagatgcagatgaaaacttacgaaactcccggacatgattggagcgcctgttgttttcagataaataattgtttgtttaccggagattcctatttgcctcaacacaaagtggtaacgacttttccaaaaagtaacaagagggaggcagaaaagtctttagagcgcattaaaaaaattgctgtaggatgcaacctctatccgggacatggagaaatcatatatgcgtaaatatgggctgctgctgttaagtgttttttcttttctttttattccttactacgtaagaaaatcaaataaacatagataatttcgttatgaacaaacgaatctggctttcgcttgctcacatgggtggccgtgagcaagactttataaaagaggcctttgatacgaactgggtagttcctttggggcctaacgtggatgcttttgagcaatctttggccgaatatttgcatgaagaccgtcatgtggtggccttgagtgctggaacggctgcgctccatttgggcttgattcttctggatgtgaagcccggtgatgaagtgatttgccaaagctttacttttgccgcctctgccaatccgatttcttatctggaggccaaacctgtttttgtggacagtgagaaggatacctggaatatggatccggtattgctcgaggaggctataaaggaccgtttgcgcaagacgggcaggttgccgaaagcgatcattcccgttcacctttacggtatgcctgccaagatggatgagatcatggatattgcggggcgttatggtattcccgtattggaggatgctgccgaggctttgggttcggagttgaacggacagaagtgtggcacattcggtgaactggccgcactctctttcaatggcaacaagatgatcacgacttccggtggaggtgctctgatctgtcgcacggaagaggaggtccggcaaacaaagttctatgcgacgcaggctcgtgatgccgctccgcattaccagcatactcatatcggttataattaccgtatgagcaacatctgtgcgggtatcggccgtggccagatgtacgttctggaagagcatattgcgcgtcgccgtgctattcactctttgtatgttgatttgctgaaagatgttgcgggtattacggtcatggagaatcctgattcacggtttgcttccaacttttggctgacttgtattctggttgatccgaagcttgcgggcaagagtcgtgaggatcttcgcctgaagctggatgccgcaaacatagagactcgtcctttgtggaagccgatgcatcttcagcctgtgttcagggatgctccgttctatgggaatggtacgagtgagaggttgttcgatatcggtctttgtctgccttcgggtcctacattgacagatgaagatatcaggagggtggtagatacgatcaagaagatataatagattcattgtatcagtattataaaggaaagccggctggaatatttgaaaaattccggccggctttcctttatatatatgggaatacaagaaaactaaattttacttttccgggaaacgaattgcttttgaatatatttcttttacctttgtgagaaaatacttaaaataaattgctatggaaaaattatactttcaaagagctgcttcattagggctgcttttctgtcttcttgcaggaacatgggctcagacacctctgaaaacaaagaagaaaaaagaacataagtcgcaaacagaagtatcggtaaacgaatgcgtatcggtggatacgttgtctttggtatcgtttaacgatttccatggagcctttgccagcgataagggagtgcccggggcagggaaattagtacaaactatcttgactcaaaaagaacaaaataaaaatacaatagtgctttcggtcggcgataatttcagcgggagttatttctcaagaataacaagaggtaatccgttgcctgaaatgtttcgggagatggatgtcaagatgtcagcggtaggtaaccatgaatttgactggggattaccttatctgacggatacagccaaagtatatatgaactttgtagctgccaatatcatttcagaacggggggattcgttggagtgggcaaaaccttaccggattgtgaatctggagatgaaaaacggaggaatggtgcgtgttgcttttgtcggattgacaacaacggaaactgcccataagacgagtccggaaaatatcaaaggattggcttttgtacatcccacatatgttgcccgtgtcgagacggcttgccggttgaagaaagaggggaaggtggatctggtggtgcttctgatgcacattggtaccaatatgaaaaataaagatattattgaagaagagaatgccaagtcacttccttatcttaatggagtggacgctatcatttccggtcattcccatgaagtggtgcttagtaaggtgaacgatgttcccatcattcaggcaggagtcaacggtacacacgtcggtaaactggatttcaaggttgtcagagaaggagggagttgtaaggtttcttatatcggtggcgatactattcgtaccggtgaggtttcgaatccatatattgattcattggtcaataatgtactggaagaatatggattgtcggatagtttgactaatgctaaggatgctttgatccatgaccgtaccgttaataagtgggactatacctctgtgggagcttatgtgactgctgcctacgtgcagagtttcttgcaaagtgaatgtgtggcggatgaattgaaaaaattacctgtgattggagtgaatcattacgggggcttacgtgccggtattccggccggaaaggtcacaaagttgcgtgccggtaatgtgctcccattcggtggcaatgtggtggcttatgaatttacgggtgaacgattgaagcagttgttggacgatggacgcagaaataaaaatggttttctgcaaacttcttacttaaaattacatttgaattctaaaggaaatattgaaacgataaccgactgccgtaccaataagataatccgtgatgacgataaatgtattgttgtgttggatgctttcattacttccggtggtgacggttatgacagcaaattattttcaggttatgaaataggagattttaataatcagaaacttgaaacaaccacggcttttatcgattatttgaagagtctgaaagggtttatttcgtctgcggctgcaccgatacccatagtgcaaaagtaaaaaattagagctaagatgaaagcgatcaggcggtttaaaatgtaattacacattttgagccatctgatcgcttttgtgttttttaagttttttgtctttcacttattaataaattattgctaaattcgaacgatttttttgcaaatcgacattgtttactaataatttaatttatatggaaaatctggaaacagcgcttctgctgatggtagtcggaatggcaactgtctttgctattctccttcttgtgatctatttaggaaaattactcatctctttagttaataaatatgtccctgaggaacaacctcttgtgaaacagggagctaaagtatcagctcctattcccggtaatattgttgcagccattacagcggctgtcaatgtagtgacacaaggaaaagggaaagtgactaaaatcgagaaaatctgaaaattaatcttatagaataataccgaaaacggaaatgaaaagagaagtaaaatttagtctggtttttagagacatgtggcagtctgccggtaaatatgtgcctcgggtagaccagttagtgaaggtagcacctgctattgttgaaatgggatgttttgcccgggtagaaacaaacggcggtggttttgaacaagtaaatctattgtttggtgagaaccccaataaatctgtgcgcgcatggacgaagcccttccatgaagccggaatacaaacccatatgttggatcgtgcccttaacgggcttcgtatgagtccggttccggccgatgtgcgtaagttgttttataaagtaaagaaagcacaggggacggatatcacccgtacattctgtgggctgaatgatgtacgtaacattgcaccttccatcacttatgccaaagaagcgggaatgatttcgcagtgttcactctgcatcacccattcgccgattcacacggtggagtactacaccaacatggcattagaattaattaaattgggggcggacgagatttgcattaaagacatggcaggtatcggacgtcccgtttctttaggcaagattgtggcaaatatcaaagcagcacatcccgatattcctattcaatatcacagtcacgcgggaccgggttttaatatggccagcattttggaagtatgtgaggccgggtgtgattatgtggatgtcggaatggaaccgttgtcatggggaacgggacatgccgatttgttgagtgtgcaggccatgttgaaggatgcgggattccaggtgcctgagattaatatggaggcctatatgaaggtgcgggctctgattcaggaattcatggacgactttctggggctgtatatcagtccgaaaaaccggctgatgaattcattattgatagctccgggacttccgggcggaatgatgggaagcctgatggcggatttggaagcgaatctggaatccattaataagtataaggcaaaacacaatcttcctttcatgacacaagatcagcttctgatcaagttgttcaatgaagtggcttatgtatggccccgcgtcggatatcctcctttggtaactcctttcagccagtatgtgaaaaatctctcgatgatgaatgttatcgcgatggagaaaggaaaagagcgttggggaatgattgctgatgatatttgggatatgattctgggtaaagccggacgtctgccgggcaagctcgctcctgagataatagagaaagccgagagagaaggaaggaaattctttgagggaaatccgcaggataactatccggacgatcttgacaaatatcgcaaactgatgaaagaaaagaagtgggagacaggcgaggacgatgaagaactctttgaatatgcgatgcatccggctcaatatgaagcttataagagcgggaaagcgaaagaagatttcttggccgatgtggcaaaacgcagggcggagaaagaacaggcacctgctgaagaggcaaaacccaaaacacttacagtacaggtagacgggcaagcttaccgggtgacagttgcttacggagatacggaactgcctgttgcaccggcttcacagccgtctgctgctgcaggtgagggaaaagaggtgctttctccgctcgaaggaaaattcttcctggtgaagaatgcgcaagagactccgctcaaggtaggcgatgcggtaaaagaaggtgatgtgctttgctacgtggaagcaatgaaaacctataatgccatccgtgctgaatttggtggaacggtaacagctatttctgcaaatcccggcgatacggtttctgaagatgatgtattaatgaagataggatgatgaacggaatatttgaaaaattatatgatatgactgctttcagcaatattgttgccgaaccgcagtttttggtgatgtatgtcatcgccttcgttctcttgtatctgggtataaagaagcaatacgagcccctcttattggtaccgattgcctttggagtattgctggctaacttccccggtggagggatgggagtgatacaggctgacgagaatggcatgatcttggtgaacggagtaatgaagaatatctgggagatgcctctccatgatattgctcatgaattgggattgatgaactttgtatattatatgcttataaagacagggtttcttcccccgatcatttttatgggagtgggagcattgacggacttcgggccgatgcttcgcaatctgcgtctgtcgattttcggggctgcggcccaattgggtatcttcaccgtattgttggtagctatcctgatgggatttacacccagtgaagcggcttctttgggaattatcggtggtgcggacgggcctacggctatctttaccaccatcaagttggctcctcatctgttgggaccgattgcgattgccgcctattcttatatggcactggttccggttatcataccattggtcgttcggcttttgtgtaccaagaaggaactgagcattaatatgaaagagcaggaaaagaaatacccttcgaaaacggaaatcaaaaatctccgcgtactgaagattgttttcccgattgtggtgactacggttgtagctctttttgtaccgagtgcagtgcctttgatcggtatgctgatgttcggtaacctggtgaaagagatcggtgccaatactttccgtctgtttgatgcggcttcaaatagtataatgaatgcggcaaccatttttctgggtttgtcggtaggagccactatgacgagtgaagccttcctgaactggacgactatcggtattgtagtaggaggattcctggcttttgccttgtctatagcaggaggtatcttctttgtgaaactggtgaacctgtttacgaagaaaaagattaatccgctgattggtgctacgggacttagtgccgttcctatggccagccgtgtagccaatgacattgccttgaaatatgattctaaaaatcatgtattgcaatattgcatggccagcaatatctcgggagtgatcgggtctgctgtagcggcaggggtgctgatctcttttctgtcttaatagagccggaaagatatccggttcatcataggtgataaaaaatgttcctccgaccacgcctggccggaggaacacacacaaacaaaacaaataaaagctgccacgattcacatcgggacgcccctacgcccggcattaaaccgggacttataaatattgaaagggatcaacatttattcttttgaaaagtctttgattcgttgctcttccgataattggcatataagcagtatattgtctttttcagccacgatatagtcattcagaccttgtatgactacccgtttctcttgtgaggtatgtaccatgcagttccggctttcgtacatccggacatctgttcctactgtggcattgccttctttgtctttgggcaacagactctgcagtgctccccaggttcccaagtcggaccatccgaactttgcgggcagtacataaatctcttctgctttttccatcaccgcataatctattgaaatactttcggctgtgggaaatagtctttttacagtctcttcctcacgttctgtatagaagtcgggataaatccggtcgaagatctgtgctatgcccggtgcataaacccgcatgactgctgtgattgttctcacattccatacgaaaatccctgcattccagaaataattacctgccgtcagatatttttcggctgtctctttattgggtttttccctgaaagactctacatggaatatttctttatcccttgctatgggttcgcctgcggcaatatacccataaccggtttccggacgtccgggttttatgccgagtgtaatgatggcactgcttttatccgtaaacgagagtgccttgtctattactctgcgaaattcggtggtatcaatcaccacttggtcagaaggagtgaccacaatgttggcatccggatatttcttttttattttccagcaggcatacgctatgcaaggagccgtatttctgggacagggctctgccagtatgttgttttccggtatacccgacaattgttcctgaacaatgtctttatacctttcagatgtgactacccatatgttttcttgcgggcaaaggttgccgaatctttcggctgtcaattggagcagtgttttcccacatcccaatatatctatgaattgtttgggacattccggtgtactcatcggccagaagcggcttcctatgccaccggccataattactacatgattattcatcgttggtcctttccttttatttgttacgtttgccgaacagtttccctatccagtttgaatcaccggccgatttctgtctgtcagatagaacgggttcgtatggtttttgttcatggatcatctggtagatggttccccagtcaggtaaacctcccaggttccggtcatcaatgaaaaggtctgctttcagtttgcgggagaatccgtgatgattcttttcttcttccggatagtctttattgacggcatagaagtagactccccgctgccggcaccattcaatggcttcttcaagtaactcaccttcgcgtacagtccataaaatcagtttgtgacgttcttttgccagcattttcagagtctctgtggcgaatggaatttcttctccgatcttcggatagcggtgttctacgatggtaccatcaaaatcaacagcaatcgtcatgtaattagtgtgtgtgaatggttattattatttagtttcgggaatgtatacaatcatggcattgcatcccgttttgttttcgtatcccatcgcttccggagtcgattcggtgattcgttcgggcgcgatatgatgtttttctatcaatcttttccggatggcttccgaacggcggctgcgcaattcctggtctgctttcttgtctgtaagattatcgctgaaagcaatgatttggatgcttgagttattatccttcatccattcacctataccgtctatcttctgtccctgttcttcactgacgaatgaactgaattcatcgaacatgatgtcgatggagagtgcatctttttgcggaacaatcattaagttctggccatccattatcttccggcgttcctttaattcctgtttcatttgcattacctcttcacaaagtatccctactttctgctttatttccagaagatccgtttccggcatatagagtgattgggtactgttatttatactcttccgatatttatctctgaaagtatatgcaagtccgattgtcaggttgctttgcatataaattttgttgttcagttccttgttgtagtatttgggtaaaatcttcaatcccggttctataaatacactgaactttctgtttacattgtacgaagcctgaattgagaagttccccgaaatagtgtttactcttgtgtatttcgggtcattgtctccaaagtcataatagttgaaaccggcacctaaaatagccgtcaggttgaatcttttgaatccattatttcctatcagagtcagcatataatccaggtttgcgctgagttgtgtggcctctgcattattttctatccggttcttaccaatctccgcagtggccctgaagcccgagaaaggtgtcagatatactcctccggagactttgccgcctgcatacacgttaccgatagtcttggtcatccattctccattcagagcacccgatacaaaccaattacctttttcaaacttttccttgacgtttggctgttcctgtgcctgtaagttacaagttgtcagtagcagtgctgccccaacgatccatttattttgtttcaatcccaatatacctgtcatggttgtgctatattaatacgacatttattgatgcaatctgtttctttttgtttcccggaccggtcacgacaattgaagtgatatagagtttatctcctttttccaactgtctgatcaattccatttgcctggccgagaatttgtttccggtgttggttattgaagttaccgctttactgtttcctttaatcaataccatttcaaaactgttaatctcgtagttggctttcggaccatcactgattgaagcccccaattgtgtcatgttggataccagccgtttgttaatgggtacatttcctcggtattgcactgtatttccattgtcatccgtacagaggatatagggtgtcggatcgggcaatgcctttacggtatatcgatactcgaccagttgtcttgccactccgttttttatctgtgtggcggttatggttgctgtctgtgctttttcattgggaacggcgatgcattgatttcctcttttaagtatctttccattagtcatattgaatgtcacctcgttgaatgggattcccgcagtcagtatatttaacgggttttcatagtcggtatacaagatacttgttaaggtgggtgtaatctgtactacaggcaaatccaccgttccgtctctatttactatcatctggtcttcattgataaatacaaaggtcccgctttttccgtcttccgcttcttcatacagcaatgaccgatatacttcgtttacacacagcagcacctcttcctgtattttgttgatgaatgtcactccaccgatggcagggaggtaggagaacgtctctttttcccaggaaatgcctgtgcccggtccttccgtatccagataagtgccgaccagtttccggtgtgattcatttttaatcagtgatagcgtctccgctttgaatgcttccagtgagagcctgagcattttgcctttgcctccggtcaccgacaggaatacttccggcacagcattcaggtcgtctttagccttcagttttcccgtttcatatttttctttgtccgctttccgcgcaatatcttctttcagtccttccagtgtgcccatcagcttccctgctgttgcgtctatgctctgtgctgataaggttgcctgatcattccggctgttgttgattcgttccagtaaagtccggttatattcttccaactgctctatttgtggaagataatcattattcatcagtccatatccttccaagacatccgatgatatattgatagccagcatggcaatcagcaccacatacagcaggtttatcattttttgtcttggcggtaatgtatatttagccatgtgtttctgttatttccctgtttttacgttcatggcattcagcatctgactgtattgtttgttaagcaattcgatgtatgctgccattttttccatttcttttttcaactcttccgaattcatatcgttcaacgacttggcatgttcggtcatgcctttaatctgtgcttcgtatgtttcattgagttttccgatgttgctttccaatcttttcagttgctgtaggtacttttccgccaccagcgtgtctgctactcccgtgttcggatttatgtttgcgtttttgtcattcaataacggaaacactctttcccatttgtactctcttgccggttcatcaaatccggaaatgaagaaaatgaatacttccgtaaataatccgatcatcaataacagattatcataaggcatgtgagctattttaaatacagctcccagaattacaagacaggctccccaacaatagcagaggttatagaaacgttttcctgttctgctcgataagaatttacttaatttcattggtcaatccgtttttgaattctccacagagtgtaccgatttttacctggttgatcatttcttttatcggtataaaaacgaccgctgccaatcagtgtaattctgtggagaatctctgagttattagaatttgtatattacgcctacggtcatcatgccggcggcaaacacatcatccttattttccacatcatagaacttggtgctgattttaattcccggttctgcaaagacacttagtttcgagttcagtttgaaggcagcctgcagagagaaattaccgcttatcgtattcgttttcgataaattcggaaagtcgttatcaaatgaatagtagttgtatcccagtccgaaaatcgcattcagccggaacttgctgtcttcatttgtatagttcttcatcaagctcaccatgatgtctgctccggcacctgccgttacagcgttgtatccgtctttcagccacacattaccggcctccgcgttgacacgcagaccgataatcttgtttaaccacactccgccggatactttacctcccagcatgttgcttgccgaaccgtttaaagccgatagtccatttatacctcccgacacaaaccactccggtttgaacggattgtcctgtgctttcatatttccgaatgccatcagcaatcctaccaagagcaatactgtttttatattattcagcttcataatttagttatttagtaaaagaatagtgtttacaggatcgattttaaactttacctcccgagtgctggcttgcttccacattcgtgtaagttatcttcattcccgtataaaatttcagagtaatcgttacagttcttccgccactgattttgaacgtgtatttcttttcgcaatatttggcctggttcaggtaataaagaatatgattaccgctgataccggccaccagttcctgattcactttgtatatgcctgtcgtgccttcttgcgcttcgatggcactgttgatcatagatgccattccttttgcatccgtagcgtttacaccggcattggttaatgctgtttccggagtcactgtatattcccatccggctgttgcctcaaagttgattttatattcagggatggctgtcatatttccttcgttactctttttctcctctttgtttgtctcgcctatttgctctgaaccggtagtcttgctacttttgatacgcattgaatacttaccggacagtgttgctccggcaggtaatgtaaatgtatagctgttcgatgtcacgtcataggcagcatcagccactttgtcccagctttctccagctcttgttgtcaccttctggttgtacacttccacgtcctcaaatgtggcattttccgaggctttgttcaccactgccagtgtgaccggtttggcaagtgtcacggcctccgttgttgccacttcgatattggcaatagccaccggagtttccactgttcctgttgtcacggtagttgtggcggctgcaggctcttcataaggagtgatgcttacgttggttgttgtttcaatcgctccaggagggacaattacggctgcttccgcctttgtcatgtcactgtgccctttgtctgttacaattatttcttctgtcgctgcggcatctatttccttggcgggactctgcttgcttagttttacgcttaagctcaccatgctgcggttctccgcattgtctgcaatggtggcctgtgcattatctatactcaggtatccttcttttgtaaaagtaacggtatatgttttcttactgtctaccgtcagtttgtatgctccttccgcatctgtggtagctgtagcctcgcctgcctttacttccacaccgggcagagcagtgcttccttcggtaactttacctgcgatgtagtactctatcgttttctcggcagggtccactactatttccggcttcttctcgtcttcgccgaaagagcatccggttgttcccaaggtggttgccaccagcaacacacctatcttaaataagtcactttttttcataatcatttttgtcattaagaaaatattaaaattgctttttatttctctctttttcgatacttctgatcaggaagtatcgtatatattccggttggaagtatccgctgctccggttctctgccgggcgtgtctgataggtatatcccattttcttatcggcatactcaccccatgacaccatgctgtattcggctgcaaagaattcggccggcttgattcttatggcatggttccggttccatttctttccgggcaacgggatggcaaaatgaaagcccccgttgatctctccttctacgtacatggcgtatactcccacagcatattctccgaagtggcgtgtgcagtcacctcttattccgcagtcgccgtatagataccttccggcctgtaaatccaattggacattgaattgcggaacatagagcgaacctttcacggccgcgttgatgcgttgccttgtcccgatataccatccttcgtccgtgatggccgaatatccggttgttcctatctgtgcgcccagttccacccgtccgttcccggtgcggtatttcacttccgcctgtgcgccgatccggtgattggtaaagttacctatcacgatacgtcccagaaagttgttacggaaccttatctcctgtgagagtgtcatcacacccggccgtatcttccggtattcccctttcatattggtcgcgatggggaaaaccacctgtgctgttgcttctgctcctttccataaagccatttccacggcaggagacagattcaccgtatatgaatataatttctcaaaagtcgagttttctaaagatacttccggatacaggacgatgtccgctttccatgccgagcggttgatcacttctgtgcttttcttcaataaccgcatgggacggtcggtgctgtaactcaggctcattcgttcgtatacctctttcagcgttatcttatccggccttgtaaccggttatcaatgtatccggcagacagatactcagttggggaatcccgtttccgtccagcgccaccagttccagatttccgctacttatgccttccattccggcgacaatcgcttttcctattccgcgataagttccccgatatacattgtcctcaaaagcagcgatggttgttcccccggcttcggttgtccggatattctccagacctaactccctgagtttacgggccacttgcgcatggatcatgacagggcaggagaggagcaggccgattataattatcaatttcttcttcatacggattaatggattaaaacgcattcatatcgtattccggcagaaatacatttaaactcccgggtaaatacattcagtgagagatgtttccataatttggctgctgctcctacgttaaatccgtcggagtcatactcggccatgacggacagtggtttgcaaaaggagggagtatagctgaggccgccgaatataccgtcctgtaagatatacttgtctttactcaatgggtgatagtaacctgcggtcgctgccagtcgatgtccgcctatcctaaagttctttgtaagcactccgtatacggatgcgaaataatttgtacccttgtccttgaacggatcgttacttccaatgactactgccggccaatatttaccttctttcagcggacgtatcctgaccgataaagacctgtcctgctgattgaatttgggctttgtagccatatagtcacttttcagcaagatgcaacggtaattcaattctaagaatgaaaagaaagtgatgttcacgaaatagtttccggaattatattgaaacggattcagttctttgggcaagtagttgccaccgatcataaacgttcccgtctgctgcatctcggcggtcggaatgttcatcatccccgttgtccccatggtgtactgtgccttgattcccgatgccatcaccattacacagaccgttaatactgctttttttaatctcattgatttatgttatatggagaatttttctttggtgatgttccataggaacaaggcatttccgatgatataccggcgccacatccgtttaggctctttgatcaggcgatacagccattccagtccgtgctcctgccaccagaccggagcacgttccaccgtacccgcaaagaagtcgaataccgctccgatggttcctatgtgtccgtttacctccagttcatccagatgcgcatacgcccatttctcttgtttgggagccgtcatgcctatccataataagtccggcttcgcctcgtttatggcatctatcatcattcggttttcttcttgtgtaaactccggtttgtagggaggagagtaagccttgatctgaatattcggatatatggttttagctttttctttaatcagcttaagtgtattcccgttgcttcccagaaagtagcagatgcctcctttccggttcaaccgtcccatttcatattcaaaaagatcccatccggcggtacgttctatgctctctttccggagccacctgaaagccagcaccatgcttgccccgtccggaatcagtgctccgcctttgagcaaagcttctgcaaattcagcatctttcagcgccgtattatatgaatgggcattaatcgtgtttatcaataatttaccttcaggcaataccgataagtcgctcctgtgcttcaggagtgaaactgttttaagcttcaacatgttttgtgaaaaaggaatgggtgattataagtacgctacgctgttacctgtcacgaagaacaggctttcgaatgatgtggtaagaatttttttgcaaaggtatgctttttcggataaagagaaaaattttattgaaaaaagatatctgtacatattgttttcatgtggtgtgcctttccttctgttattgtgacaatacttttttatatagactaatcatctgcttggctttattatcccacgatagttcctcttgacgggctttgcaattttcagacatccgctttagtacatctctatggttaaataggtatgttatcttctccgcaaaatcgttgatggattgttgcggagtagataagggaacttttactcccacttgttcgttgacagaatctccatggccacatacatcgaaacagatgacaggaaggttattaccgattgcttctaaaacgacatgtggagttccttcagctatgctggtaaaaaagaaaacatctgccttccgcataagtccttgaacttcatgatgggggataaccccatgccagatacattgatgtgatatgttcaattccatcgctaacttttgataggagttattgttaccacctatgatatggagttttatttgtggatttgccagttgtgctatggtttttagagctaaagataactgtttcctaaaatctaatttccctacccagagcaaatttaaatcatctttttcttttgtactgtttattatggttgttttaggataacatcctgtttcatttaataagggagagtcaatatgaaaatatttctttaaactcttctgagattcggaagatgcggatattactacagaggctttctgcacggctttgtgtactcgtcgtgaatatcgtagctgcaaacctgttatatgattttttaatctgatgaataagttcgcttttatgcctgcaccttttagatatgccgtcggaaacttttctttagcgtctaccggtccccaaacaagtggcttatctattttccaaaggtatccgggttctctaaagccaatcatatttaattggtgtataatatctatatgttgtttgactattatttcctgtgccatctcataagttttccattgccatttcttatagtgtttatagaaacgccaatctccttgattccaacacatttttcttacttcttctgaaaccggattgtagtaaaagtgcatgtgtttcccttgaggcagggtagggagtgctgcctctattttgtctctgaattcaccttcagtgatgatgtataactcacaatacttggcaagatttgtacaccaattccaagccatacccggttcacttcccatgctgggagagcaagcataagcgttgataagtataaatatcatctctatttaattaatgtttatagctttcttcaaatcaaaggggactggagaaagaaattgtagaaatagtgatgtgatcactttaagaatatatgccgctgtgcatatcagtgtaaatacaataatagtattaaatggaaatagaaaattgaatttatcagtaatgatgtgaaattgaacaatgtatatttctaaagtaagattagagattattaagagtagccatttccatcttgaagattgaaataaagtggtacaccaatgataactggctgttttatatgcatagaagatgaatagatgcaaaggtaataagcctactatttgaaagtagtatttataatcttgttttccttttcctatataaagaatgataaagtataaaacgaaccaaaagatcgtccataaacagtctttccataatgatgttatttctattttatctttatatagatatgtcatccctcccattatcataatactaaaatggcaaataaaatgaaagtttgtatgaaaaatggagcctgttgctttaggcatgaaataaaagtatagtaaggatactgctatagagagcataaaaagtattttttgcatacatattttactccccccccccatgatagaaatattgagatttccaaaaatataaaataaaatataataaattgcgatacattgcagaaaccagtacttatcagcgatcaccaggtcttgccaagtgatgggcgtattccaaataatagcggctataatgctccataaaaaaacggaaggccatagcctttgtatttttttcttataccaattaataaataaatcttttttcttttcaaatcccatcattagcagaaaaccggatacgaagaaaaatagggcattcccatgtactccaaaagtggccaaagagggtgatatatctttgtataaaggaataaaatgagaattggttataaatatggcagcgagaacttttaagaagtccaaattgtaatatcttgtgggcatgtgatttgctgttttattttcaaaaaaaatcactttaatcttttctttaaatattaataaagtcatatctaaatataagtaagagaaatgaagagggaatattttttgactgttttatgagacaaaggacatatgtacactgataataagaattgtaaataccaaaagcacagtaaagtaactatatacgatggagtataaagtttttgatttcattttgggacagaatgtagtaggatttcgtttaatctttcttcgaatttcgaaatggtaaattgtctaagatatatttctctcccttttttacccatatcgtttttgtcgggattttcaataaaagaaagcatggcatcctttagttgttctatattttgttgttctattaaaattccattctcaccattttgaataatactgggaatacctccttcgtaagtgctaatacaaggtaaaccatattccatagcttccaataacacgaggccaaaagtttcaccatgataaaatgttgggaatacaaaaacatcactataagtgaagaatttttctttttctattccatatttaggcccgtgtacaaagacatgtttttccaactttttttcagatattttattttgaaattctttataggtagtatccccccagttgcctacataatgacattcgaaatctttattgttttttttgagtaaggtgcatgcttccagcaaaatccagattcctttttctgacatcatgttactcaagtataaaaaatgcactttgtataatgattcttttctctgttttatgacttttttatatttttcttccgatagtgtagggggaagcccattgggtaaatagaataaatctttaggattcacaaactcagaaatgtcgtcatacaactctttagcaataagtattacttttacattgctgaagtttattttataagcaatttgagcaagtcgtttttttgcgaaataacgtactcctttgttatgcatatgtaggataatctttcttctgcatagcttcattagtaatatggtaatgctatctctataaataccccatccatctgatgtaggagtgtaatagcatatatccggtttgactttgataatagctttcagtatctgatattggatagagaataggaaaataattttttttaaactgattttgccaacttctgtgatattgcttgaggcagatgggttaatataatgacattcaaaagttttgttgataagtttgctgtcatgaatccactgacctaccatagcagctccatgtacaggaggaggcatatgcatgataaataatactttcggtttcattttaatggatgatgtacattattctactccataatcttatcataatagaatggtaagacatagctgaacgatataatttcttatttagtgatatatgagatggtaatttgaattctttatctccatcttcatcgaattcatatttaaagcggctccattttttacaattagtgccttgcccattgaacccgtcgttttttactttactggtaatagggaataaggacactttatcttgtagaaattcagagaacccaaaacgtatggcccatgaatctccccagccttctttgactgagagtaacattccgtaacaatcggaacctccccatttgttaaacgcttttttcatttgagagtatttatcccaattttttaattcccagtctatggttttccaacgatcttgccatgttgcccatccccacgaactactacgagtacaaaaataagcatcatacggataatctttgggaggagatactttattggaatatccacatatggaaaatactttttgttctgtttcataccgatttaatccctcgttcataaatgcgagaaaattgggcgagaagactaaatcatcctctaaaacaattgctttgccatatttcccaatgacagttgtcactccttgaatgatggaattgcccaatcctttattggttggggaaaagaatgtttcaatatgtttgaatccagtgattgattttacatattcctgcacttttgccacattttctttttcattaggtttatttgctcttgctccatccacgaatatgaacagatcggaatctttagattctttattttccaatagggaaagtaccgtgttttttaaagcgttagggcgattaaaagcaaatatgattataggtgcatacatattatttaattgtgtaaataaagttctacttttgttttaccatcatttgatattacttttgcggggatacctacggctacactattatctggtatatcggatacaacaactgcattggccccaattataacattgtgtccgatttttattccaccaatgattttggctccggaagttagtactacattatttcctatgataggcacaccacctttatttcctcttacattaccaatagtgactccttggaaaatagtgcagttgtctcctattgtacatgtgctatttatgatgatacatgaaaagtgtgcaaaacacaaaccttctcctatttgagttccgataggtaattggattcctgtcaaatattgattgtgtttatgtatcaaaaaaactattccatataatagtttaaagaatatccctttttggcgggctaaatagctgcctattctgaaccaaaaggtgatgcggaaagaagcgttgaaaaataggtattttaccccccccctatttaacttttgttaatctatttaaatctgattttatcagatatttacattctttgaaagtcatcgtccgatgcagctgtattcaaatcctagattcttcatttcttgcgcatcatatatgttacgtccgtcaatgattagtgttttgttcattgatttctgcaataccccccagcttggcagacggaactgtttccattctgttattagcagcaatgcgtctgcgtttagaatcgcatcatacatatctgcggcatactctaccgcctcacctatacggcgatggcattcatccattgctatcggatcgtatacacgtaccttgcatcctgctttgagtaattcgtcaattgtgaccaaagccgtagcttcacgcatgtcatctgtttccggtttaaaagccaatccccagatggcaatggtttttccctttaaagctcctccataataggctgaaagcttcctgaataaaatacttttctgcctttcgtttacttcttccacagctttcagcactttcatttcgtagccatttttttcggccgtttttatcaatgcttttacatccttggggaaacaactacctccatatccacatcccggatagaggaatttacttccgatacggctgtccgctccgatacctttacgcaccatgttcacatccgcacccaccacctcgcataggtttgcgatgtcattcatgaaactgatacgtgtggccagcatcgagtttaccgcatattttatcatttctgctgaaggaatatcagtaaagataatccgatagttgttcatcataaatggtttgtagagtttactcataagctctctggctctttctgattctacgcccaccactacccggtcggggctcataaagtcttttatggcggcaccttctttcaggaattccggattcgaagccacatcaaattctatttctattcctctcttatccaattcctcctgaatggctgccttgactttctttgcagtaccgacgggtacggtcgatttggtaacaagtatcaggtacttcttcatattccggcccactgtccgggcaacttcaagtacataggtcaggtcagcactgccatcttcgtccgggggagtacccaccgcactaaaaacaacatccacattgtccaggcatgttgtaatatctgtggtgaaattcaatctgccctctcgatgattacggagtaccatttcttccaaacccggctcataaatagggatttgtccttgtaataatcttgttatcttttcttcgttcacgtctacacaagtcacgttgactcccatttccgcaaagcaagtgccggatactaatccgacataacctgtacctactactgctatattcatattgataatgatttaatgtcttttttgatatgctttataaatctgtgttatgattcctaagattgttttccggattcctaccatcttaatggtaaaaagaataggatgttgaacatgattctgcatcttttttaatcgttcatcttttaagtttaaaacaactggtagtgcgacttttaggaatggtataccgtgatgggctgacttaaatggtagttggtaaatcccttttagatctgctatatgtttatgctgttcaatatcccattgtgaaccattcgaatagaaataataaatatcggtatgcggattaaggaatgggatgatatcgaaatatttgtttttgccactcttttccagtctgaaaacaagaggattaatcttttctgaacttcggttcaataacgatttcaattcgtattgcggattaaatgcgagtaccttctttgtttgaagtagagagccatataagatggcggcatatgctccggctgagcttcctaacatcacggtatgatatccttcggtttcttttcttagaaattcgattagcttttccggagtgtttatgtttgaattgattcctgccaaataccattgtttgaatacatctcgtatgaagatatgtttatacgctttttttatgcgtgaaccataccattcgaagaaattcttctcaataattcttttcttgaaaatctcttctgtattcggataatagatatcattgctgcaaaaatagacagcgcaataatccttatccgtacactgtgtattgtattctattaaatagtttggctggttgcggtatacgtcttgtacgatcttagaatctgtttgaaaaacaaaacaagattgattggctatttccatagttgcgggaataaaactcggatatgaatagatataaaatgcttcagtgctgtagataaaccgaaatttcttttctcaaaatggaagaaaggaatcggttcggcatatcccaatggggaatataaatttttgatacgttgtaccaatgggacttcttttcgtgcccatgccggcaagcggggattcaggtcacatatacctaaatactcggttgacacgtatattttaaaccctgcttttctcgctctgtatccgtaatctaagtcacctatggcatggcggaaagtccaatccagatttcctatcttattgaaaatcatttcaggaataagaacacagtttccattgaatgtctcgcattcctgtagggtaccatcaggagttattttcccctttgaggtatggccgctataggtcgtttcatttctttgtgaggagcatattgaagctacaattattgcttgttgatgggtttgcttactatggagcaatagcttatttaatgtgttgtcgaataagaatgtatcgtcgtttagccataggtaatagtcgtatttttttcttccggctgcttcttcccaagctgtatacattccccggttccaaaacaaatttcctttcgaatggattatgtttacttcggggaatttttgtgagatagcttccggtgtaccgtctgtgcatccatcattggttagatagatgtcaacgctatatccttggatagggagttgtttgtaaagattgccaaggcattggagtgttttctctttccggttaaaaacggtgagtaaaactgctattgatttcattttttatatgttttttatgaatctggcaggattccctgcccatatttggttagcaggtacatttttggtcacaacggaacctgctccgatgatagagttttctccaatagtaacccctttaagtataatggattgtgctccaatgaatacactgttttcaatgatgacaggtttctctattcgcattttcaagtcatcattacttttacgtattttcggatttaaagaatgaaagtctgtgtcatagatgcatacacctccacctatttttacatcatcacctatggacatatatttatggcagatcaaggctgcttgtgatatacctacgttattaccgataatcaattctgcattcctgtctacgaagaaagtacatttttggtaacatcccatgggatttccttttattccgttattcattgcaaattttttgccgataataaacttacctcccatagccaccatgatataaggaattcctgatgtgcgataatcttcaaattgaacattatttccctttaaaagccaccaacaataagccttctcaaggagatttcttatttttccatttacttttcggaccgacttataaatcaagtttaatatcattgttttaatatggactgataaatgttattcaaattctgagcgtttatttctttgttatgtcgtaacattgctatttctcgttcatttttcattaatttctcacataacttactgttctcaaaaagttcacaaactcgttgtgccaatagagctgtctcttcgtatcgataaagaaagcctgtttcgttgtctgttatcatatccatagttcctcctgtataagaagctatacaaggtgtacctatcaattgcgcttctcctacagaattagggctgttctctatagccgaaggacagatgaatacgtgggcctttgtatattgttcggccatttcttcttcggagagtatacccagaaagtgaattgtattttctacatggtatgcttttattaatctttgtatatagttcgcaaaaccgttttttcgtaaaagggaagttgatataaaattatttccggcaacatatatttgtgtgtcaggataatgctgtagaataataggaagagcttttattacttgttgcaaacctttgagtggataatgtgcctgacttaaaaaaatagtatgtttttggcaagtatgatactcccattttttatgataaaaagtagggcgtaatgtttcattgcagaaatgatatgttaggttaggggagatagcccacacatttgatcgatcccaactagttcggcctatcacatgatttactatgtgcaaaagctgtttctcatactctccacgtaaatacattttattttgttgggtcaataggctatcttttcgaatgatgtcgcgaaaggtttttgttttttgtatctctcttgcagatatccctcctaaataatattgtgcacatatgcttaccatgccttgtatggaaataactatattttttgtattacaggctttagcgcatgctaatgaatgtggatattctgaaccatgtatatggattatgtcaggggtgaagtgctcttctatttgtttaaaatattgttcccattctttgttatagcattgatttccttttatttggggaattaaataatattgtattttataatttgttactatctttaactctttgcctgaatataaagaggcaacagctaaatccaaatggggattattttccaataatgctaaagcactggcatacatccatccgcctacaaccgggggtgtcatgtgtaactcattacagacctccggaaatataatattagatacccaaagaactttcatatcttttttgttttttgattaaaaaaatccctttcacccactgctgcatatctttattagtcatcattctgaatggttcggagaaacaaactcccaagaatatgatattcatcatgaagaaggtctcaaataaaggtttttcccaaatgaaactccatgtccacaggaaggctgtatatataccgattcctttcatatatatacttctgcttttatatattgctaaataactggctctgatgtacattagaaaaaaaaggataactcctataagaccataccaaagcaagatatccaatattcctacttcatttccgtatcttccgattagtttggtggtttcatcttttcctctgtcaacccacaatggtccttcgtctccaaaggcaggacttcgtcctgttatccaggcattatatttattcattgtataaaatacattttcataaattgccgtacgggtatcagcttttaaattatctttataatattgcccgtcagatcctttggcttttaattcataatttcccttaatgtattcatccattttgaatacgttgaattttccgcttactcctaaagatagcaatacaataggtagtaccaataaaacgacatggatacatttgaaaaaccaggagggaatgatcttcccagaataggaaatgcctaaacctattgcggatgctactaacattttaatcatgtcatttctttgttcttgagtaatgaagaagaagaggacaatccctaataagaaccattttctctttcccggaatcaatgcaaaaaaaagtaatagagtagaatatggaagataatttaagtatccgggatcatgtaataatagaatagaaattccaattaatggaagatagtatttccaaaaacatcgatataatccttgaagccagtatggattggaacctatcaatataatactataaaataatgttgtaagtaaattgttgattataaacttccacatccaatatccttccgcataatggcagcttcttaaaaaaccgattatcagccataatataaaggcacatgtgatgatatagccatatttatctatagtcctgaatggtgcatatttccttgctccttgtaatagcagaaagagtatgatggttctgaatccccaagtaacgggttccggaaaatggaaaacttgtgatactatgatgtataacatcacactgaatccagcccagataagtgtctttagattatttcggattagattcattcaaggctgttttgaataagtttaagtattggtctactgtttggtccttagtatttttgttactaaactgtatagcatttattgccatttgttccctttttgcgggattgtccattagtgcctttaaccgtttgatgaatactttgatgttgttattgggaataatgataccattgtattcatttgtgataatatctgtgattgattcaaaactgttataagagatgggaatcacccccatttgttgcccttccatcagtaccataggccatccttcgtattttgaggccattatcatgatagatgactctttgtaaaagggtagaggagaggtgtaacccataaaatgtatacgttttaagttcatcttttgtgctaatttgagaatctgtttaaatccttcgccttcgccaacgaatgttaattcccaatcgaggtaattattatcagcttctatagctttccatattttgaatagtacaggaatcctttttacgtgattggtagaacaaactattaatactcttttctttttctgatgtagctcttcgattggatatgattcatcgaatactactgggtttccgatagctgcgactttttctttttgggcataaggaattacccgttggcggaattaacttagtgcgtatttaattctgccaataggcttgttatgtcgccgtttttttcagagagttcatcccctcgggtcagaagacacgaggggatgacttgtttatagacgtaggaaaagaaggagggaggataacaaccgaactgatgcactcgtttataaataaaatactacttaaaatacgaatatttactgataatttgtatgttatgaggattattattcgtatctttgtcgcccgaattatgtctacctacttaagattcagatgaaaattagttaagtagtacataacgtttgggctttttttgtacctttgcaacgattaaaaaaaagaagctttgggaaagtttgataaatacaaaattgatttgaaaggaatgcaagcagactcatgtaagtatgagtttctacttgacaatctttttttcgctcatattgatggccctgaagttcagaaaggtaaagtcaacgtagagttgacggttaaaaagacctctcgtgcttttgaattgagcttccagacagaaggtatcgtatgggtaccatgtgaccgttgtttggatgagatggagcagccggttacttcctcagataagttgatggtaaaatttggccgtgaatatgctgaagagggagataatctgattgtgatccctgaggaagaaggggagatcaatgtagcttggtttatgtacgagtttatagctttggctatcccgatgaagcatgtgcatgctcccggtaaatgcaataaagctgtgaccagtaagctgaacaagcatcttagaacaagtggtgatgacgatgcagaagaatcttttggcgctggtgaggatatcgttgtggaagatgaagcggaggaacagattgatccgcgctggaatgaattaaaaaaaatattagataataattaaagtttaaaagaaaatggcacatcctaagagaagacaatcaaaaacaagaactgcaaagagaagaactcatgataaagcagtagctcctacattggctatttgcccgaactgcggtgaatggcatgtttaccacacagtatgcggcgcttgcggatactacagaggtaagctggcaattgaaaaagaagctgctgtataattgcagtctgaataagcttatacttatcaaacagccagagagcaatgctctccggctgctttaagtattagatgtattgctaaattaaaacagaattgatggaaaaaataaatgcagtaatcacaggagtcggaggatatgtacctgattatgtcttgacaaacgacgagatatctaagatggtggataccaatgacgagtggattatgactcgtatcggagtaaaagaaagacgaatactgaacgaagagggattaggtacttcgtatatggcccgtaaggcagctaaacagttgatgaaaaaaacgggttcaaatcctgatgacattgatttagttatcgttgcaactactactcctgactatcatttcccctcaacagcttctattctttgtgataaactcggactaaaaaatgcttttgctttcgatctacaggctgcttgtagcggattcttgtatctgatggaaacagctgccaattttattcgttcgggacgatataaaaaagtaatcattgttggtgccgataaaatgtcatcaatggtggattacacagaacgtgcaacatgccctatcttcggtgatggagcggcagcttttatgcttgaaccgaccacggaagacttgggaattatggatgctatattgagaactgatggtaagggattgcctttcctccacatgaaagcgggtggttcggtttgtcctccttcttatttcacggttgacaataaaatgcattatattcatcaggaaggtagaactgtgttcaagtacgctgtctctaatatgtctgatgtcagtgcagctatagcagaaaagaacggactgacaaaagataacattgactggattgttccccatcaagccaatatgcgcatcatcgaagcggtagctcatcgcatggaagttccgatggagaaagttctggtggatattcagcattacggtaatacgagtgcgggtacgctgccattgtgtatctgggattttgaagagaaacttaagaaaggcgataacattattttcactgcgtttggtgccggatttacttggggtgccgtgtatgtgaaatggggttacgacgggaaaaaagaatagtaacgaaagttgctaatataaatcacataaaacgcatcttatttcgattcgatgcgtttttttgtctaaatcaataaatggaaggcgatgcataaagctggttttgtgaatatagtaggaaatcccaatgtgggtaagtcgacactgatgaatgtgttggtaggcgaacgtatttcaattgctacgtttaaggcgcagactactcgtcaccggattatgggtatctataatacggatgatatgcagattgttttttcggatactccgggggtgttgaaacctaattataagttgcaggaatctatgctgaacttttctacttcagcattagcggatgcagatgtcttgctttatgtgacagacgtgattgaaactcctgataagaataatgaatttattcagaaagtgcgtcagcagactgctccggttttgttattgattaacaagattgacttgactgaccaggaaaagctggtgaagctggtggaagactggaaagagttgcttccacaagctgagattattccgatttcggcagctacaaagttcaatgtggactatgtgatgaagcggatcaaagaacttttgcctgactcacctccttattttgataaggaccagtggactgataagccggcccgtttctttgtcaacgagattatccgtgagaagatcctgttgtactatgataaagagattccgtactcggtagaggtggtggtggagcaattcaaagaagatgcgaagaagatacacattcatgccgtgatttatgtagagcgtgattctcagaaagggattattataggaaaacagggtaaagccctgaagaaagttgctacagaggcacggcgggatctggaacgttttttcggaaaaactgtttttctggaaacctatgtgaaagtagacaaagattggcgcagctctgacaaggaattgcggaattttggttatcagttagattaaaaaaagaaaattcatacgactgtgatagtcgcaaaaataaagtgtgtaaactatgggaaatttagttgcaatcgtaggacgacccaatgtgggcaagtctaccttatttaatcgtttgacgaaaacccgtcaggcaattgtgaacgatgaagcgggtactacccgtgataggcagtatggtaaatccgaatggttagggcgagagttttctgttgttgataccggtggatgggtagtaaactctgacgatatattcgaagaggaaatccgcaagcaggtattgatggcagtggatgaagcggatgtgattctgtttgtggtggatgtgacaaatggagtgacagatttggatatgcaggtagctgccatattacgccgtgccaaaagtccggtcatcatggtggccaataagacggataatcatgagctgcgatacaatgctcctgagttttatcggttgggattgggcgatccttattgtatctctgcgattagtggtagtggtacaggagatctgatggacttgattgttagtaaattcaagaaagaatccgatgagattctggatgaagacatccctcgtttcgctgtggtgggacgtcctaatgccggtaaatcgtctattgtgaatgcttttatcggggaagaacgtaatattgttacagaaatagccggaacaacccgcgattctatttacactcgttacaataagtttggcttcgatttctatctggtagatacagccggcattcgtaaaaagaataaggtaaacgaggatctcgaatattattcggttgtccgttctattcgtgccatagagggggccgatgtatgtattctgatggtggatgcgacccgtggtatagaaagccaggatttgaatatattctcgttgattcagaaaaactcaaaagggttagtggtagtcgtgaataagtgggatcttgtagaaaacaagactgataaagtaatgaagacttttgaagaagccattcgttcacgttttgctccttttgttgatttccctattgtgtttgcatcggcattgacaaaacagagaattctcaaggtgcttgaagaggcacgtaaagtttacgagaaccgtgtgattaaaattccgacagctcgcctgaacgaagagatgcttccgttgatcgaagcttatccgcctcctgcgactaagggaaaatatatcaagattaagtacgttactcagctgcctaatacgcaggtaccctcgtttgtcttctttgctaatcttccacagtacgtgaaagagccttatagaagattcctggagaacaagatgcgtgaaaagtgggatctgagtggaacgcctatcaacatttatatcagacagaagtgatttttgtgtcgaatagtattggtatataaatgtaaaagccggattatcataattccggctttctttttgcccatcatttttgaaataattgattctttttgtttcttatataactctttttatttatatttgtacagagcaaaaagaaacaaaccataaatacagacagaggctacatggaaacgaaggcagaaatactattggttgacgatcatgcactgattcttgaagggatgcaacgcatgcttgagttagtgccgggggttaaagttgccgatgcggtgacttcgggaacgagagctgccgaattgattggggagagagactacgacatctatgttttggatgtaagcctccccgatatatcaggattcgatttggttgatatgattcgtgagattaatgagagtgcacgtattattattagtactatgcatgaagaaatctggattatcaaccgtttgattcgtcagaaagtgaatgctgtgatccttaaatcatccgaagctatggaaataggaaatgccgtgaagagcgtgcttgcaggtgattcttatgcatgtccgcggtttaagtccattcgtcagaggttaagcctcagtcctgtacaaattcatcctaaagatatacccacaaagcgcgagcttgatgtactgaaagctgtcgcaaggggatgtaatacgcatgaagttgcggctgaattgaagatttcagaaaatactgtcgaaacatttcgcaaaaggctaatacaaaagttttgtgcaaagaacgctatcgatatggtagtgaaagctatggcaaaaggatggatagagattggatgattctatttatttcaatttgtcacggttttcggtgatgttttgctgcattttttttgttatctttgatgtgtaattggaattattctctttttaagttttattgagaactttgggacagtcaatatgtcgtgatgatatatgtcgattctattaactggtttttttataacaaaaagtgggctcatgaattgcgatgattcatgagcccttctatttcaatctgttgagaagatcagccttcgaggttttgtatttctacatcctttactttacgcagcaggtcggaagcgaaaatgaaattgttcagctgttcgttggtcgaagtgaagatgtcgtctttcgtaccttcccactctttggttccctgataaatatagataatcttttcgccaatacccattaccgagttcatgtcgtgagtattgatgatggtggtcatgttgtactcccgggtaatatcgtgaatcaggtcgtctattaccaaagaggttttcgggtcgagtcctgagttcggttcatcgcagaagagatactgcgggttcagcgcaatggcccgtgcgatagctacacgtttctgcataccgccactgatttcgccgggaaatttatctttagcttctgtcaggttgacccgatcgaggcagaacatggcccgtttggtttgttcgcgcaatgtatcggtaccgaacatgttgagagggaacattacgttatccaaaacggacatggagtcgaacaaagccgcgctttggaaaatcattcccatttcgcgtcgcaaatgtttcttttcttttttacccattgccagaaagttgcgtccgtcatagagtacttcacccttttccggtgtcagcaatccgacgatgcacttcatcaataccgtcttacccgaaccgctttgaccgataatcaggctggtttttccgttttcgaaagaggcatctatattatgcaataccgttttaccttcgaatgatttatagagtccttttacttcgatcatcccattaaaagtttagttaataccaggtcggcaaacaaaatcagtacgctgctggaaaccaccgaatcggtagatgcctttcccacttctatcgagccgccctctacggtatagccgaaaaaagaggatacactggcaatgataaaggcaaaaaacagtgacttgatgatgccgcaccacacaaaccattctacaaacatatactggagtccgtattcaaggtcggtggccgtcataataccgccgaaccagcaggtggcgaatgctccgatgatacctgcaaagatactgaaggtcaccagaataggaatcatggtaaccattgccgtgattttgggtaatatcagatagttggcggaattcactcccatgatttcgagtgcatcaatctgctgtgtcacacgcattgtacccagttcggaagcgatgttcgatcccactttaccggccaggatcagacacatgatggaggaggagaactcaagcaaaagaatctcacgagtgacgtatcccactgtccagcggggcatccatgggctttcgatgtttagtttaatctggatggtaatcaccgcgccgatgaagaatgaaatcaacagcacgatgccgatagagtttacccccagttgctctatctctttgatatattgccggaagaacatacgcatgcgctcgggacgtgaaaaagtccgtcccataagcatcatgtatctgccgacggttcttaatgctttaatcataactcgtatatttgtttgcaaatgtacgttttttcggcttatttttgctacatttgccgcaaaataacaaaggatatgaaagaaagcaagatggtgcttcgtaccgaagacttggtgaaaaagtacggtaagcgtacggtagtgagccatgtttccatcaatgtgaagcagggtgagattgtaggtttgctgggaccgaatggtgccggtaagaccacttcgttctacatgaccgtaggattgattaccccgaatgaaggccgtattttcctggacgatcttgaaataacgaaatatcctgtttataaacgtgctcagaccggtatcggatatctggctcaggaagcttcggtcttccgccagatgacggtggaggacaacattgcttccgtgcttgagatgactaataaacctctcgattatcagaaagataagctcgaaagtttgattgccgagtttcgtttgcagaaagtgcggaagaataaaggtacccagttgtcgggtggtgagcgccgccgtacggagatcgcgcgttgtctggctatcgaccccaaattcatcatgctcgatgaaccctttgccggggtagacccgattgccgtagaagatatccagcagattgtatggaagttgaaagataaaaacatcggtatcctgattaccgaccataacgtacaggaaacattgagtattaccgatcgtgcctatctgctgttcgaaggaaaaattctgtttcagggtacccctgaggagttggctgagaataagattgtgcgtgagaaatatctgagtaacagtttcgttttgcggcgcaaagacttccagttgaaagattagtctgctgtttccgttctcctgtgtatcgggggagccgcttgaacatagaatacataaaaaaaaccttttaccggttcttctggtaaaaggtttctttttaattctttctcctatcgttaatctctcggtctggcttctttgagtaccatagtacggccttcgtattccgctccgtttaattctgcgatagcttttgttgcagctgcatcgtcatccatttctacgaaaccaaaaccttttgatctgcctgtttcgcgatcgatgattactttacaagaagttacttttccgtagtcttccataacttgttgcagatctgcttccttaacacggtagttaaggtttccaacataaatgttcataatgaaaatgataaaaataaaataaatgaaataaaaaactctccggaagatgatttaataataaaaagattaaagaaacagagagtttacaaaagcgtcttgtcgacgggagtaaaaaccttgtaatcgaaatcgagaaactaatcgatcatctttccgcaacaaagaaacacataaaatccggaattgcaataactttttctctttttttgtgtgcgaaacctatgaaatttaacggattggagagatattaggatgaagttggaaaacataagttgtaaagaagatactgacttcccggtgttacggtgaaggtggcggaagtttgatagcattttgtcaaaatgacaatcgtatcctctcatatttgtttatttcggaggaccattcgtctaggtcagaaaaaacgtcttccagccagtttagccattatctttttgtttacccgatgaccggtttctggacagactgaaagagaaacatatcctcttgatgcatcatgtacttttttatgtcaaatacttgttcttccgatagtccggccgcgtcgtttcgcggagagcaaccagagtgaaaaaagagttcggaagcttctttttccgaaacaatatatgcaattggggaaaacatttaaagaaatccggaaaagaagtaagcgttttccggaaatgctaacgtctttcggggcaaatgtacccgtcttttccgcaaaaagaagcttgcttttcagtaaaacataggttttgtttccggaaaagtcaggctttgggaggcaaaaagccaccttccggagttctatttcctccggatggagcggagaaacgaaaagccgagtcagcagaaagaaggatttttgatccttttgacagtataatctccgattattgctataattgatatttgtggtagcacttcgttagcaatgaaccggtttccgacctccttatccacatccggttgtgttgaacttcactgctttgccggcctctgttccggacttttccgtccgggtctgtctttttgttttcttcttttttggttaataaaaagtaaaacgggttcttttgaaaacggattaatgtcttttctgccgtatgtccggctgctttcgtccgaaatggcgattctctgcaaatgaaataattctgcaatgttttttgaaatttgaaagattagcactaattttgcaccctcgtttgagtatagaataaagtataaatcaaataaataattgtcagaatgaacgtttcattacaaaacattgacaaagtaagcgcattgcttaccgtgaagcttgaaaaagctgactaccagcctcaggtagacaaatcgttgaagaacatccgtcagaaagctcaggttccgggattccgtccgggcatggttcctatgagcttggtgaagaagatgtatggtaagtcagtcattgccgacgaggtgaacaaattgctttctgagaaagtatacgaatacattaaggagaataacgtaaacatccttggcgaaccgatgcctaacgaagaaaagcagccggatatcgatttcgatacaatggaagaattcgaatttgtattcgatatcgctttggctccggagttcaaagctgaggttagcagccaggacaaggtagactactatacaatcgaggtaactgacgaaatggtagaaaaccagattaaagcttatactcaacgtaacggaaaatacgaacaggtagaggcatacgaagaaaacgatatgctgaaaggtctgttggccgaacttgatgaagaaggcaacacgaaagaaggcggtattcaggtagaaggtgctgtaatgatgccttcgtacatgaagaacgacgagcagaaggctatcttcgcaaacgctaaagtaaacgacgtactggtattcaatccggatgctgcttacgaaggcaatgctgttgaaatcgcatcactgctgaagatcgacaaagaagctgctgccgaagtaaaatccaacttcagcttccaggtagaagaagtgacccgtttcgtaaacggtgaactgaatcaggaactcttcgatcaggtattcggcaaagacgcagtgaagacagaagaagaattccgtgctaaagtaaaagaaagcatcgcagcccagttcgttgccgatagcgattataaattcctgatcgatgtccgcaaggtattggcagacaaagtaggtaagctggaattcccggatgcactgctgaaacgcgttatgttgatgaacaacaaagacaaaggcgaagaattcgtaaacgaaaactacgataagagcatcgaagaactgacatggcacctgattaaggaacagttggtgaaagaaaatgatatcaaggtagagcaggacgacgtgatcaacatggcgaaagaagctacaaaagctcagtttgctcaatacggtatgctgactatacccgatgatatcctcgaaaactacgcaaaagagatgctgaaaaagaaagaaagcatcgacggtttggtgaaccgcgtagtagaaaccaaattggccgctgcactgaaaggcaaggttacattggagaacaaaaccgtttcaatggaagaattcaataagatgtttgaataagctcttcttttgaacaggacataaagtcacagaaacacagagtttttataaaattataactctgtgtttttttgtgtctctgtgttcttttttgtttctttgcagttacattattaataatagaaaggaacgtaaaacaatggatgattttagaaaatacgcaaccaagcatttaggtatgaatgcaatggtgctggacgatgtgattaaatcgcaagccgggtatttgaatccctatattctggaagaaagacaactgaatgtcactcagctcgacgtgttctcacgcctgatgatggaccgtattatcttcctcggtacacagattgacgactatacagccaatacgctgcaagcacagttgctgtatcttgattcggtagatccgggtaaagatatctcaatctatatcaactctccgggcggatcggtttatgccggactgggtatttatgatacgatgcagttcatttcgagtgatgtggctacaatctgtaccggtatggcagcttctatggcttctgtactgttggtggccggtgccaaaggcaaacgttcggcgctgcctcactcacgtgtgatgattcatcagccgatgggtggcgcgcagggacaagcctcggatattgaaatcactgcccgcgaaatacaaaaattaaagaaagaactttataccattattgccgatcattcgggtacttcttttgacaaggtatgggccgattcggaccgtgattactggatgaccgcccaggaagcaaaagaatatggtatgattgacgaagtgttgattaagaaataaacatggctgaatcaaagaataataaaaaaaggtgtagcttttgcggccgttcggagaatgaagtcggattcctgattacagggatgaacggctacatttgcgacagctgtgcgacccaggcttatgagattactcaggaagccatgggagccggcaaacagagcgcgggagctacccgactcaatttaaaggaactacccaaaccggtagaaataaagaatttcctcgaccagtacgtgattggccaggacgatgccaaacgttttcttgccgtatcggtatataaccactacaaacgtctgttgcagaaagacagcggtgatgatgtggagattgaaaagtcgaacatcattatggtgggcagcaccggaaccggtaaaacccttttggcgcgtaccatagccaaactgttgcatgtaccctttacgatagtggatgcgaccgtgctgaccgaagccggttatgtaggcgaagatatcgagagtatcctcacccgtctgcttcaggtggccgattacaatgtgcccgaggcagaacaaggcattgtcttcatcgacgagatagacaagattgcccgtaagggagacaacccctccatcacgcgtgatgtcagcggtgaaggcgtacagcagggattgcttaaactgctcgaaggctctgtggtcaacgtcccgcctcagggaggacgtaagcatcccgaccagaagatgattcccgtaaacacgaaaaacatccttttcatctgtggaggagcgtttgacggcatcgagaaaaagattgcccagcgtctcaacacccatgtcgtaggatacaatgcttcccgtaagacggctactatcgacaaaaacaacatgatgcaatacatcgcaccgcaggatttgaagtcattcggactgattccggagattatcggccgtttgccggtgctgacctatctgaacccgctcgaccggaatgcacttcgtgccattctgaccgaacccaagaattccattatcaaacaatacatcaagttgttcgaaatggatggtgtgcagttgaccttccagcccgaagtcttcgaatatatcgtcgacaaggcagtggagtataaactgggtgcccgcggattgcgctctatcgtggagacaattatgatggatgtcatgttcgagattccttctgaaaaccagaaagaatatgaagtgacactggattatgcgaagcatcagctcgaaaaagcaaatcttgcgagattgcaaactgcttaaaatcaaaaggtaagggcaataatggaggtgagttccgttttttcttgaaaaatattagtctgattatgcttgatatttaagaagttgtttataactttgttagagcgctttccaagcaaagcgagtgtttttaagttaaaccatgaactgaataaaacaacctatattaagatggcagggaagattaatttgacagaccaactgaaaaagtatttcggatttgataatttcaaggggaaccaggagccgatcatccagaatttgcttgatggtaatgatacctttgtgctgatgcctaccggcggtggaaaatctctgtgctatcagttgccttctttattaatggaaggtacggccattgtgatttctccgctgatcgcgctgatgaagaatcaggtagatgcgatgcgcaacttcagtgaagaagacggtgtggctcatttcattaattcttctttgaacaagggtgcgattgatcaggtgaggtctgacattcttgccggaaaaacaaaactgttatacgttgctcccgagtcgttgacgaaagaagagaatgtggagtttctgcgttcagtaaagatttcattctatgctgtcgacgaagcacattgtatttccgaatggggacacgacttccgcccggaatatcgcaggatacgtccgattattaatgaaataggaaaagcacctcttattgcgctgaccgcaacggccacgccgaaggtgcagcacgatattcagaagaacttgggaatggtggatgcacacgtcttcaagtcttcgttcaaccgtccgaatctgtattacgaggtacgtcctaaaactcagaatgtagataaggacatcataaagttcatcaagaacaatccggaaaaatcgggcatcatttattgcctgagccggaagaaggtagaagagcttgctgagatacttcaagccaacgggatcaatgcccgtgcttatcatgcaggtatggattcggcaacgcgaacgcagaatcaggacaatttcctgatggaaaagatcgacgtaattgtagctactatcgcatttggaatgggaattgataagcccgatgtgcgatacgtcatccactatgatataccaaagagcctggaggggtattaccaggaaacaggccgcgccggaagagacggcggagaaggccagtgcattaccttttatacaaacaaagacttgcagaaactcgagaagttcatgcaaggcaaacctgtggcagaacaagaaattggcaagcagcttctgttggaaactgctgcgtatgctgaatcttccgtttgccgccgtaagacattactacattatttcggcgaagagtacacggaagagaattgtggaaattgtgacaactgtttaaaccctaaaaaacaagtggaggctcaagaattattgtgtgctgtgatcgaaacaatcatagcggtaaaagaaaattttaaggcagattatattattgatgtcctgcagggacgcgaaacgtctgaagttcaggcacacttacatgaagatctggaagtgttcggatcaggaatgggagaagaagacaaaacctggaatgccgtgattcgtcaggcgttgatagccggttatctgagtaaggatgtagaaaactacggtttgctgaaagtgaccgatgcgggaaagaaattccttaaacatcccaagtcattcaagattaccgaggacaatgactttgaagaagtggaagaagaaacaccggcaagaggtggaggttcgtgtgcagtcgatccggttctttattctatgctgaaagacctccggaaaaagttatcgaagaaactggaagtgcctccttacgtgattttccaggatccctctcttgaagcgatggctactatctatcctgtgacgctcgaagaacttcagaatatcccgggcgtaggtgccggaaaagccaaacgttacggcgaagaattctgcaagctgattaagagacattgcgaagagaatgagattgaacgtccggaggacttacgggtacgcactgtcgccaacaagtcgaagatgaaagtggccattattcaagccatcgaccgtaaagtggctctagatgatatcgcgctttccaagggcattgagttcagcgaattgctggatgaagtggaagcgatcgtttattcgggtactaagttgaatatcgactacttcctggatgagatcatggacgaagatcacatgctcgacatctacgattacttcaaagagtcgacaacagataagattgacgacgctcttgatgaactcggggacgaatttaccgaagaagaagtccgtctggttcgtatcaagtttatctccgaaatggctaattaaaaaagcgaaaaaaacttgcgtgcacttatgcagtcttgaataaaaactgtatatttgcacgcaataatttttaaacgcatagccctatgtcatttattgccgataagattgtaatggatggattaacttatgacgacgtattgttgatccccgcttattctgaagttttaccacgcactgtcgatctctcgacaaagttttcaaaaaacattgagttaaagattccgtttgtaactgccgccatggacacggttaccgaagccaagatggccattgccattgcgcgcgaagggggaattggcgtgatccataagaatatgtccattaaggaacaggctaagcaggtggctactgtgaagcgtgccgagaacggtatgatttacgatcctgtcactattaagcaagggtctaccgtacgtgatgctctcgccctgatgtccgaatacaagatcggcggcattccggtagtggatgacaatagatatttggttggtattgtaacgaatcgtgaccttcgtttcgaacgtaacatggataaacgtatcgacgaggtgatgacaaaagaaaatctggttaccaccaatcagtctaccgatctggaagcagctgcgcaaattctgcaacaccataagattgagaagctgccggtagtcgataaagaaggaaaactgatcgggctggttacttacaaagatattacaaaagccaaagataaacctatggcttgcaaagattcgaaaggccgtctgcgtgtagctgccggtgtaggtgtgactgccgacactttcgaccgtatgcaggcgttggtggatgctggtgcggatgccatcgtgatcgatacggctcacggacactcaaagggagtgatcgacaccttgcgcgaagcgaaaaaacgttatcccaatattgatattgtggttggtaacattgctacgggcgatgcagccaaggccttggtggaagccggggctgacggtgtaaaagtaggtatcggcccgggttccatttgtacgacacgtgtggttgccggtgtaggcgtaccgcaactttcggctgtttatgatgtagccaaagccttgaaaggtacaggtatccctttgattgccgatggcggactccgctattcgggtgatgtggtgaaagctctggctgccggaggatactgtgtgatgatcggttcattggttgccggtacagaagaaagtccgggcgagacgattatcttcaatggacgtaagtttaagtcataccgtggtatgggttctctcgaagcgatggaaaatggttcgaaagaccgctatttccaaagtggcgagatggatgtgaagaagttggttccggaaggcattgctgcccgtgtgccttataaaggaactttatatgaagtgatttatcagctgaccggtggtttgcgtgccggtatgggatattgcggtgctcctgatatcgagaaactgcatgatgccaagtttactcgcatcaccaatgccggagtaatggaaagccatccgcacgatgtgacgattacaagcgaatcgcctaattacagtcgtccggaataacagcctgtttatcggtcgtttggccgttgccgtctggttgctgttccaccacagattacacggattaacacagaactttttaatcttcaatatcaatgagataaattatcaatctgtgttaatccgtgtcctttgtagtgaactcgatttattttattccgatatgaatatctcaacgtagaatggtatgaagaagattctggttggtgcactgacctgtttgtttgggtttattgccggctatgcccggcaagatcctgtgttgatgcggatcaatggacaagacatttcccgctcggagtttgagtctttctatcatcggaataagccttcgggagtatccgggaaagaagccttgaaggtttgtgttgatctctttgtcgataagaagttgaaactgcatgcggcacagagagccgggttggatactctctctgcctttcgtgcggagatggacaactaccatcgttcattatctaaatcctatcttacagattcgtctgcagaggaagcctgtgccagaaagctttacgatcagatgaagagccgctccatagccggcgaggtccgggttatgcatattttccgttatcttccccagacggccctgccccatcatttgcgggaggcgcaggctttaatggactctctttacaatgtattgaagacaaatcccgatgccgatttcaagactctggtagaccaatattctgatgataaggcagaatcctggatcagttggttgcagacaccacaggaatttgaggaggtcgctttctctttgaaggatggcgaatattcccagccgttttttactcctaaaggacttcatatcgttaaagtgacgggcagacgcgaactccctccatttgaacagatacgggacaggctaatccgtaaactgtcccatcgtccgggtgcggataaaggaaccgaaattcgggtaaacaaactgaaggagagctatcggtatactccggacaaagcggcgatggaagagttgctttctcaaggcaagacctcccgtactctttttacgctggacggtaaaaactttacagggaaggactttgagcggtttgccgctgcccatcccatggggacaaagaggcagttggatgcttttgtggtaaaatcaattctcgattatgagaacagtcgccttgagcagaaacatcctgagttccgcaggacgctgcaagaacatcgtgatcatttgctgctggccgctattacccgccgggaaacccatcaggtcagcctggcagattctgttgcactgaagaacttcttcaaggagcaccggaccgattacaactgggattcaccccgctacagaggtgcggtgttgcacggaacccataagaaaacgctgaagagcgcccgtaaatttctgaaaaaacttccggaagaagagtggaaagatgccattcgcctgacatttaatacctctgcttcaccggctgtcatccggatagaacaagggacctttgccgaaggtgacaatgtttttgtcgataagttagtgtttaaaaaaggagacttcgaaccattaaagtcctatccttttaccgttgttttgggtgagaaaaagaaaggtccggagtcctacaaagagattgtttcccgtttgatcgaagattatcagaatcatctggatgcactttgggcagagcgtctcagggcttctgctaaggttgaaattaaccaagaggttttaaaaacggttaataatcactgaagcaacgaattattgtattatcttcgtaccttaaattaagtataattcagttgacaatgcgaaaaacgggccttctgctaatctctctccttttctgtgtgtcgtgtactgacaagcatgatcacaaaggacagactcctttggtagaggtcgatggaaactttttgtacaaagaggaccttcaggccgtgttccccgccggtttgtcgaaagatgacagtcttcttttcgccgagcactacattcgtagctgggttgaagacgttttgttgtttaaccaggcgcaaagcaatatccccgacaacggcgaaatcgataagttggtcgcaaattaccggaaagcattgatcatgtatacttatcaacaagaactaatcagccagaaattgtcgggcgagatccccgaacaggaaatagcagactattacgaaaagaacaaagaactgtttaaactggaccgtccgttgatgaaaggtctgtttatcaaggttccccttaccgctccccaactgggaaatgtccgtaagtggtataagacggagactcaggatgccgttgagcatttggagaagtatagtttgcagaatgctgtgaagtatgagtatttttatgataaatgggtgcgggtagccgatgtacttgatatgatcccgttgaaagcggaatccccggaagcctatatggataagaaccgtcatatcgaactgaaagatacggcattctactattttctgaatatcagcgattttcgtgtggcaggcgaacaggaaccttacgagtttgcccaaccgaaagttaaagatatgcttgtcaatatcaagcgggttgattttatgaaacaagtaaaggacgacttgtacgaacgtgcagtaaaaagaaagaagattataaattattaaatacacagaatgaagaagtttgtgaactttaaatttgttgttatgtttgccctggcactggttgctaacgtggcatcctatgcgcaggacaatgtgattgacgaagtggtttgggtcgttggtgacgaagccatcctgaagtccgatgtggaagaagcacgactggccgctttgtatgaggggcgtaagtttgatggtgatccttattgtgtgattcccgaagagttggcggtacagaaactttatatgcaccaggctgtgcttgatagtatcgaagttcctgaatcagaagtgatacagcgtgtcgattatcagatcaataactatattcaggctttgggtagcagagaaaggatggaagctgagtttaacaagacttctacgcagatccgcgaagccatgcgcgagaatgcccgtgacggattgattgtacagagaatgcagcagaagctggtaggtgatatcaaagtgactccggccgaagtgcgccgctactttaaggagcttcctcaggatagtatcccttatgtccctactcaggtagaagtacagatcatcacgcagcaacctaaagtgcccatctctgaaatagaggatgtgaaaagacgcttgcgtgaatataccgaccgtatcaataagggcgaaagtgatttttctacgcttgccctgttgtattccgaggaccgcggttctgccatcaaaggtggtgaaaccggttttatgggtaaaggccagatggtgcccgaatacgctaatgtcgctttcaacttgcaggacactaagaagatatctaagatcgtagagtccgagtatggtttccatatcatccagttgatcgagaaacgtggcgaccgtatcaatacccgtcatatcctgttgaagcccaaagtatcggataaggagttgaatgaagccaatgcacgtcttgattccatagccaacgatattcgtagcgataagtttacattcgatcaggcagccgctgctttgtctcaggataaagacacacgcaacaatcacggtctgatgcagaatccgatgaatcagactgctaaattcgagatgcaggatttgccgcaggagatagctaaagtggtagataagatgaatatcggtgagatctccaaagccttcactatggtcaaccccaaagatggtaaggaagtttgtgctattgttaagctgaaggcacgcatcaatggacacaaagccactatcaccgatgactaccagaacctgaaagaaattgtgctcgacaaacgtcgtgaagaggcgttgcaaaaatggattgttgaaaaacaaaaacatacgtatgtgcgtattaatccggcatggcagcgttgtgactttaaatatccgggctggattaaaaaagactgatcctgatttgatatgtttagattaaacaaagaacataaattccacggcaggcatagatttctcttagcgggtattctatgcctgcttgccgtatgttttctggtggcccaggacaagaaaccgcagcatgacaagaagccacaacaggagaagaaggctgaaccggaaaagccaacgggaaataaaaagacccgtgtcgatttgctccatgccgatcgggggcaagccgataaactggcgcgtcctgatgttcaggtgctgattggttcggttaagttgcgtcacgacagcatgtatatgtattgtgacagtgccctgatttacgaaaaaacgaattcattcgaagcatttagcaatgtgcgtatggagcagggagatactcttttcatctatggtgactatttgttttatgacggcatgactcagatagcgcaactgcgtgagaatgtgaaaatgatcaaccggaatactaccttgttgacagacagcctgaattatgaccgtctgtacaatttgggttactattttgatgggggtacgttgatggatgaagaaaatgtgttgacttccgactggggtgagtacagtcctgccactaaactttctgttttcaaccatgatgtcaagctcgtgaatccccgtttcgtgcttacttccgacaccctgaagtatagtacgaatactaagattgccaccattctgggaccctccaatattgtcagcgatcagaaccatatctattccgagcggggcatttacaataccgtttccggacaagccgaactgctcgaccgttcggttttgaccaatgaaggtaagaagttgatcggtgacagccttttctatgaccgtaaagcgggttatggtgaggcgttcgataatgtccagatgaacgacactgtcaataagaacatgcttaccggtgattattgttattatgacgagttgaagcagaatgctcttgccaccaagcgagctgttgccgtggattattcacggggtgacagcctctttatgcatgccgatacgttactgatgaatagctataatctcgacaccgactcccttttccgtgagatgcgcgcttttcataaggtacgtatgtacagcgctgatctgcaaggcgtttgcgattctttggtctttaatacgaaagactcttgccttaccatgtatcgcgatcctattatttggaacgaagggcaacaactgctgggagaagaggttaaggtatatatgaacgacagtacgattgattgggctcatatcatcaatcaggcgctcacggtggaacagaaagactccattcattttaatcagatctcaggaaaagagatcaaggcatactttgccgagggtgaggcacgcaaaatagatgtgatagggaatgtacttgtagtatattatcctcaggagcaagatagcactatgattggtatgaacacctccgaaaccagtctgttgaatatgtatctcaaagaccggaaaatgcagaaaatggtcatgagtcccaaatcgaatggaacactttatccaatggatcagattccacccgacaaaatgaaattgcccactttcagttggtttgattatgtccgtcccttgaataaggaagacattttcaactggagagggaaaaaggcaggtgaggctttacgtaaaacagagcgcaaggtcatcagtggtcctaaacgtgaaataattaatatgaaatagctatgggaatgttcaatgtacgaaagccgcgtggattcaatcatcaatatatctatgtggacgagcggaaagaaaaattgacgaaaatggaagaagatgccaagcgtgatttgggaatgttacccgaaaaagaattttctccggaagatattcgcggaaagttcatcgaaggcaccacacatctgaagcgtcgtaaggagagtgggcgtaagcctgctcatttgggtgtcattctggctatcattgccctgcttatttttctatggcattatttgcagaccggtagctggtctttttaagtcctataaattaatcagtcaaagctaaatctattatgagcgatatcattcatttattacccgattcggttgccaaccagatagctgccggagaggtgatacaacgtccggcatctgtcatcaaagagttagtcgagaacgccatcgatgctgaggcacaaaatattcatgtattggttaccgatgcaggcaagacctgtatacaggtgattgatgacggtaagggaatgtccgaaaccgatgcacgcctctctttcgagcggcatgccacctcaaagatccgcgaggcatccgatctgtttgcccttcgcacgatgggctttcgtggtgaagcgctggcttccattgccgccgttgctcaggtagagctgaagactcgtcccgaatccgaagagttagggaccaggattatcattgcgggctccaaggtggagagtcaggaagcagtgtcttgtcccaaaggaagcaacttttccattaagaacctttttttcaatattcctgcccggcgtaagttcctgaaggccaactctaccgagttgagtaatattctggccgaatttgaacgtattgccctggtacatcctgaggttgctttctcactgtatagcaatgactccgaactgttcaatcttcccgcctgccatttgcggcaacgtattctttctatttttggtaagaagctcaatcagcaattgctcagtgtggaagtgaacactacgatggtgaaggtttcaggctatgtggccaagcccgaaacagcccgtaagaaaggtgcccatcagtatttctttgtgaatggccgttacatgcgtcatccttacttccataaagcggtgatggatgcttacgaacagttgattcccgcaggcgaacagatttcttatttcatctattttgaagtcgatcctgccaacatcgatgtcaatatccatcctaccaaaacagagatcaaatttgagaacgaacaggctatctggcagattctttctgcctcggtaaaagagtcgttgggcaagttcaatgccgtcccttctatcgatttcgatacggaagacatgcctgatatccctgcatttgaacagaacttgcctcctgcgcctcctaaggtgcatttcaattccgatttcaatccattcaaaccttcggtgccctcttccggcggtggcaattactcccgtccgaaagtggactgggaagatttgtacggtggtcttgagaaagccagtaagatgaatcagcctttcgccgaacccgatcccgaaccggaagaatttgcggtaattgaagaggaaagtattgttacagccgctcctgcaactctttatgccggtgagtcggccataatggagaaggggacccagcacttgcagttcaagggacgtttcattcttacttctgtaaagtccggattgatgctgatcgatcagcaccgggcccatgttcgggtgctctttgaccgttatcgtgcccagattcagcagaagcagggattctcacaaggcgttctcttccccgaaattctgcaacttccggcttctgaggcagccgtattgcaagacattatggacgatttatctgcggtaggtttcgatctcagcgatcttggtggaggcagttatgccattaacggagtaccttcaggcatcgacggactgaatccggtcgatttggtgcgcagcatgttgcataccgctatggagaaaggcaacgatgtcaaagaagaaattcaggatatccttgcgttgacccttgcccgcgcggctgccattgtctatgggcaggtgctgagtaatgaagagatggtcagtttggtcgataatctgtttgcctgtccttcgcccaactatacgccggatggtcgtgtggtattgactaccataaaagaagaagagatcgataaacttttccggtgatcatcattcttctgtacttatcagagtaagtattacgtcagttccattctatctcacacgatcgacagattttatctgtttattgcatctcctttctaataggttaataaccagtagaatactctattagtatcctccctgtacgagcaaataaagttaactcgtgcaggaaggatattaactacacgtacatataagaaattaataacctcgtaccccattcatcacctgaaaatcttgttaatagtgctgataaacatatccctaaaagaatgacattctacggatgattcgtatattgcgatatacttcttgaacagtatgcattttgctttaaactaaaatctattttatatgaagataagatatagttttattttctatttttttcttctactttcctgttcttctcctaaaagacaagaaattgtttttaatgaagaaataacttcctctgaagaagtagactatccgcttactattgatctggaggcctgtatgcgtaaccagtcattaagcataaaattgagttcctttgtggaagatgttttctatattcctataaaaaatcaaagcgaagatatctatatacgctatttaagtggcttggagtacgatgaacaaagttgcttatttattctgaatgatcccttttatgcgtttacagtagatacgttaggccattttgtgaatcagatcggacgaatagggcagggtcccggagagtacaaacagattgccaatattagtgtaaacagcgaggataagctgatttatattaagacagtttataaacacaatgtaattacgtatgattacaatggacatgtgattcgtgaatcttctcctatgggtatcgatttgtttaccgagactgttttttattatgatcatgctctttgggggatagggataccatatacatcccgtgcattgcgagtgagaaaggaaaagcgtttattctatggatatgtacttttagacagcctttgtcggcgtacttccttgcaaacagctaacccgatagaaccgtatggagatttggaaggacttgaatccggtatttcacaacccggtataagtatctataaggatgtagttttattaactcacagtggaggtgccccctcggatacagtttatactattcggaataagcaattcgttccacgttatttcttgaactatggctctcatcgtcctgatataagtaaaatttggtcgcaaggtggtggaagtagttttgatcattcatatgtttctatgaaccaggcttttgagacagaacgtttcttttttattgaaattcgtttccagggaaagtgttacattatttgctatgacaagtacataggtaaggggttttcaataccaatgactatctgtttgaatgaaagagggactccgttagcccaaggttttgagaatgatattgatgggggacttcctttctatcctcaatctgtgagtagtagcggaacttattggcttgcatacgtgaatccttccgatatgaaagagattctgacagaagaatattttgctgcccaccctgatattctgaacaaaaaaaagcaagatgagctgagagcaattgtagcaaatgctgatgaagaagataatcccatattagtattacttaaattgaggaaataagattggtgatgaaaaaaacattttaaaggtagaatcatagtttgggtcaatgaatggccgcgaagtttttctgaatatgcaactatggccctacagatgaatccacgaacgataactgtgggtaattccacttcaggagcagatgggaatatttcactttttacatttcccggagaagtcaggacaatctattctggaataggaatctattatcctgattttactcctacccaacgagtaggggtgcgtgtagattataccgtggaacctaaaattaatgatataaagaaaaaaatagataccgcatatgaggaggcaattaccattgcgaaacaagaaaagtagatttcgctgtattgatgattggaaagatttctgaatgtaagcgttataattgattactaatacttctgaagaaccatttgctttttggtaatcttgttaatagtgctgataaacatatccctaaaagaatgacattctacgaatgattcgtatcttgcggtatgctttatgaaaagtagttttttactttcagccaaaatctatttttatatgaagacaagataccttttatacccgcttctctttcttttttcggttgcaatgtctgcatcctgctcttcatctgtacccaaagagggggatataataaaagattctactttccgttctgtcgatttgcacatggtggagaaagcagaagggacagtgatgtctttgagtgatttagtggagtcatatgaagtcattaaattagagaatagggatgaggctcttgttaaaacttatccgtttgggatctttgtgacagataattatatcttgctgaatccagacgctatatctcctattaagttgtttacgcgtaaaggtcaatacgtggcggatattggtggtataggacagggtcctggggagtacaaaacgatacattcctgtatgatagatgaaaagcaaaaacgtatttacttaggttcaggaagagcaaataaaatacttacctatgacctgaaggggaattatctgtcagatgaagctatccatttcaaggaaatagtacataagccttgtatttggatggaccatgataaaaagcatgtaactgtagtgggtttgccattttctgagaatgagaactccaattttgcaattagtaacaatgtgtgctgggtgcaaaatagggagggtgatatcgtgcatcggattcctgtaaatcattacggtttaattggagattacagtaatggcttagtggcatgtcggaatgtggatgcgatttctttttcaatatttgaagatccggggttacgtactcgtcctgataccttgtatcattatgatactaaaaggaatataataataccttgttttacattagattatgttgttgctgcaaatcgaagagttgcgactattttatatgaaacaccccaaagctattggggacgtgttacattatatcctaataatacttcttcaagtgcttctcccgtccgtctgactacatttaatgtttgcgtttcgaaaaaagatggcaatgtacggcgcattgatcgctttactgatcctcttttaggtttatcttatccttatttggtaatgcagaacggttatgtctgtatctcttacgaacctcttggactgatggatgctttagataaagttcttgcccaaactgatttaaagcctgaaatacgtaaacgagtcactaatctaagaaatagtttacacgaaaatgataatgacattcttatgattgggaaacttaaatccaactattagtaacctataaattatcgtcctatgaagttagattatatcgcattgtttttggtattgttttttcttgctgcttgtggcagcaagccttcttctccggatatggtggatgataacgctttatcggctgaggaaacctttaaagacattgatcttgctaacaatctgaaagattgtggcaagcctttactgctgagtgacatcgtaaaagatgtggagtatgtgaagctggaaacgcaggataatatattagttggtagtataaatcagctaaagcggacagagaagtttgtctttatttattcaagaaatcagaaccatgtcatgatgtttgatacttcgggaaagtttatccgtaaaatcggtcgtgtaggtcagggtcctggagagatagctaatattgactttttcacagtcagtgacaatttggtatttatttatccgttcagccgtaatggcagcctgacagtctatgatatgcgggataacagcttcgtcaaggaaattcctttaaaatggcctgttttttttagtagggccatcgatgtagtgggagattgtttggtttattatcccggtactgtttattcgcctgataatagtaagacattcataagcgcttgtgttgcgaatggaaaaggggagacattgatggagcaaatcccttacttatcttctggtgacaagaaaatattacaattatcttctgatccatcttggctctatcgtggaagaagtaacgtttattcgtttattaatgatacgatctacggcattacttgtgattctatttttccccgttaccatctttctcttggaaaatataaattgccttccggaagatatgatcctactcgtgattatggttggggagattttgttctaatgaaaagtgtttatgaaactaaagaatgtcttctttttagcttttggtttaataaaaagatgtggttcagccgatacgataaaaaaacggagaagatcgattcttgggagcaaactccttttaaagctgtccattggtacatacttgatgcaccgggaataacgaatgatgttgacggttctcaatcgttcaaagatttctataatgtaggcgaaaactgtctttacttcgcaatcacaccggacaatttggatcaggtgaggcgcaacatcgctgaagctaaggtcaagttccctgagaagcaggccgaattattgaagcttcttgatgaaatgggagaggatgacaatccgattattgctttctataaattgaaagactgaaacggaatatattttagacgaaagatctggtataacggtatgtaacctgagattctttggatgtaatcagtaagtataataatacttgtaaaatttaggtttatggataaaatctatttatggcttctgcttctcatttcatgtagttgctctcatactaaagaaaaggtttctaatgacatggattcctctttggcatccttactatctgatcgataaacagagcgaagagatgtcttccattaggattgctgtggataaacctatcagtgagaaggtgcataccttcggtatatgcgtcagattcaccggtcattgtcgcttgtgaattatacaccgattcatacttgtattttagaataattccgatgtattataatccttctgctcccatgtctcctatggcggatgctcctgagcttgtgttaaacaggcatacaggcaagattgcggaatggagaatgtatgattctaattattcctccgatatagaaaggcctgtgccgactatgatgcttcagtctgctgatagagaaaattatggtataagtatgtttggggcggaaaggcttattgagcaatatcaagcgggcgggttgaagggggagctgaaggatattgcatcccgattgagtatagatgacaatgatatattgatgatctgtaaatataaataagtaaaatcaatgcaaagttagagaatatggtttggctattatgataaagaaaggctaaaatcgattcttgacagataaggattttacaccttggaagaaatttcttttataaagatgcagaatgtcctatgggatcgtatataggcagtgatgcctcagattctactaatttgcctgtagctggagtttatgtagataatacagaactacctgatccaataaaaccttggtaatattttaagtttttgtgatgtaattttgcaagattctcatggataagacaataaccgtatgtatgcagtgtattttcaaaaaacttcgttttggtgtaaaaactgtgttgttgtggctgcttatacttcactcacactgatatgctaacaaaatcagaggtctatagaaaatacatacagagagaatgatgtaataccacaaaaaacacataactttgtggcaaaattgaaagctatgggtgcaaacagctcttacaaggctatgtatgatattgtggaacaggcaaaggatggaacaattttcattcctgatgatttcgtgacgtatggtactcccgatgcggttcgttcgggattaactcgtttgtgccgtaatggaaagttataccgttttgctaaaggtatttattatgtgccgatgtacgacaagtgggatgggacactacgtgagccttcattggatgctattgcccaaaagatcgcccaaagagataatgcccgtattataccaaccggagcatacgccctcaataaacttgggctatctacgcaagttcctgctaacattatctatataacggacggttctgcgcggcaggtaagatttggcgaggggaaaagcatcatattccgacatagtaatgatttaggtaatttcgcttaccaatccaaattgatgcaactggcagtacttgccatgcgagagattggcgaaaagttgataaccgaagagcaaacagcaaaaataaagaagatgataacagagcacgtttcgggacaagacttcaatcacgatattgtgcttgctccgacgtggataaaaatgatattacaacgatgaaatttattgatttatcaaaagaagaccgcacagatatactcgaccgtgtttctacggaactgaccatacggcagcgtgaggttatagaaaaggactggtgggttacggctgtgcttcgagccatgttctgtcttccatacgcccggcatctttctttcaagggtggcacgtcattgagtaagtgttggcatctgattgaccgtttttcggaagatatagacatcgctattgatagggaatatctgggtttcagcggaactttgtcaaaaacacaaatcagcgataaagtgcgccgggctacatgttctttcgtaagagagaccatgcagcacgacattgtcgaacagttgcacaaaaacggtatcgcaaaagacaagtttcaggtaaatgtggatattacccctatctctaccactgacccggaaaccataaatatcaactatgattccgtcttgacattctctattgatggcgagaacggtttgtatgttttgcctaaagtaaaagtggaagtgagtggtaggtctatgagtgagcctgtgagcgaagtgtctcttgactcaatgattgaccaagtttacccgaaagcaccttttgcagaaccgaagttcaatgtgcgggctgttcttcctgaacgcacattccttgaaaagatattccttttgcacgaagaatttgccaaaccgaaagatttgattcgggtagaacgtatgtcacggcacatgtacgacattggtcagatgctaaaaactcctattgcagaaaaagctatccatgataaacagctttatcgtcaagtggtagagcatcgtcgcacattcatcggtttgcgtggctttgactacgacacactttatccgaatgcactgaacatcgttcctcctgcatctattataaaacagtgggaagctgattatgagaatatgcgtttgcacatgatatatggtgaatcggcatcatttgaggagttagtgaacaatcttaaagatctaaatgataggataaaggagcacatattggccaattaaatgatgcaaaatatagtagataaacagctgatgcacagttttattcacgaacaaccgagtactcacgcccatcacaagcaactgctacggcaaatgctttggaattgctttcttccggcatatacacagaagaagaaagatttatatttggactattacaaaatgccgtggatagctttaatccacaacaacaggccacattgtcaatcaaaattgttctcatagataatctattagtttttatgcacaatggtacacctttctctgaaagagacttggaaggcttatgtgatataggtaacggaaacaagacgatggatgcaaaaaaataggatataaaggcattggctttaagtccgtgtttatgcattctcatcgagtaactgtattgacagataggacatgctttaaatttgataaagaagcctgtgaaaccattgctaaatcaaaaggtacagaatacaaggatgttaaaatgccatggcagataattcctatattatcggatgtcccttctaatattaaaactgacggcttcaatgtaatcacatatatagaaaccttgaataaaaaatcactgaaacgcaaggttgaaaaacttttgaatgatactcgtttccttttattcctcaaagttgacgaccttaatatttcattttggaatgaaggggaagaaattttgaatctatctaaaaaacaaacggatgacatactcacactttcaaaaaacgggaaaccacagaacaattggcttatacattcgacagaagttaaactgacaccagaggttaaagaagctcttgtgcatgatagcaagacccctacaaaattaaaggaatcgaaatctgtagagatttcttttgctatcgccctcgatgaagataaaaacatcacacctattaaaaatgcagtgatgtacacttatcttcctacttctttttcttttggcttaaattttattgttaatgcaaactttattacagatgcggggcgtcagcaaattgtaaaagattgcacatggaatgagtctatttttgctcatatccctggatgctatctgaaatggatttaatgtttgcgtttcgaaaaaagatggcaatgtacggcgcattgatcgctttactgatcctcttttaggtttatctcatctttttttgatgatgaataatggatatatttgtatctcttatgatcctcttgaactgatggatgctttagataaagtccttgcccaaacagatttggagcctgacgtacgtaaacgggccaccgatttacgaaatagtctgcacgagaatgataatgacattcttatcattggaaaactgaaacaataactataagtaatctataaatttcgattgtatctttaaatgctatcaggcgaatcactgaaggttctcaagtatatgtgatattgatagatcgtgcaaaatgtccacgaggatgataatccaattattgccatttacaaattgaaagactgaagaattttgaatgagatgctttttaacatatccttaatagaataacattctacgaataattcgtatcttgcggtatgctttgtgaaaagtagttttttactttcagccaaaatctatttttatatgaagacaagataccttttatacccgcttctctttcttttttcggttgcaatgtctgcatcctgctcttcatctgtaccccaagagagggatataaaagaaggttccgccttttacgctgtcgatttattggaaatagagaaaataaagggtgaggaaatgttgttttctgatttgatagaatcattggaaattattaagttggatggcagagaagaggcattggttgccacttatccttccggtattgatgtttcaagcaattatatcttaatagagccggatggcgtttctgctttgaaattatttactcgtaagggacgatatgtggctgatataggtggagttggtcaaggccccggagagtacaaatatgctgtgaatagatttcttgatgaaaagcagggacgtgtggctattgccgagaatcaaaaaatgttattttttgatcttaaaggccgatttttatcgaaagagagtatttcattgccggaaacgataacgaagagttccatttggatagatttggaaaatgaaaaagctgtagtggtcgttcttccctttgctgatataggaaatccaaaagcaccgatcggtaagaatctatgctgggtacaagattttaaggggaatatcttgcaaaaaatatctgctgtaaattatgcgattatgccggattatagtaatgaagtattggctccccggaatgttgatggctattctttttccctttgtcaggttgtcgggcgtacacgccctgatactctatatcactatgatattgctaataatgtattgaaaccttgttttactttggataatgtaatgcaggaggataaatatattgtaacgtcattgtatgagactccggaatattattggagtagagtaactattggaccggctaaagtgccatcagatggttctcccgttcgtatgactgtatttaatgttcgtgtttctaaaaaagatggtagtgtgaagcgcattgatcgttttacaaatgactttttgggactttcttatcctttcttgactatgcgcaacggttatgtctgtatctcttacgaacctcttggactgatggatgctttagataaagttcttgcccaaactgatttaaagcctgaaatacgtaaacgagtcactaatctaagaaatagtttacacgaaaatgataatgacattcttatgattgggaaacttaaatccaactattagtaacctataaattatcgtcctatgaagttagattgtatcgcattgtttttgatattgttttttcttgctgcttgtggcagcaagccttcttctccggatatgatggatgataacgctttatcgactgaggaaacctttaaagatattgatcttgctaacaacttgaaagattgcggcaagcctttattgctgagtgacatcgtaaaagatgtggagtatgtgaagctggagacgcaggataatatattagtcggtagtataaatcagctaaagcggacggagaagtttgtctttatttattcatggcatcagaaccatgtcatgatgtttgatactttgggaaagtttatccgtaaaatcggtcgtgtaggtcagggtcctggagaaatagctaatattcactgtttcacagtcagtgatagtttagtgtttatttatccattcgggcacaatggcagcctaattggttatgatatgcgtgataatcgtttcgtcaggagaatttccctgaaacggcctgcttttcatagtaatatgatcgatgtgatgggggattgcttggtttattatcccggcactgttcctaatgggaatgaacgaatctttataaccgcttgtgttgtgaatggaaaaggggagacattgatggagcaaattccttacttgcatgctggaggtgataagtcggagatgaatctttcctctgatgcttcgtggatctatcaagggaggagtaatgtctattctcaaatcaacgatacgatctacggcattacctgtgactccatttatcctcgttatcatttatctcttggtaaatatggtttgcctttgggaagatatgacgttaaagatctcggtctgaaagattttataatgatgcagagtgtttgtgaaaataaagagtgtctgctctttaaattttcctataataaaaagatgtggttcagccggtacgataaaaagacagaaaagatagattcctgggaacagactcctttaaagggtatcggttggatggcgatcgaaagtccgggtataacgaatgatattgacggttctcaatcgttcgatggaatcaggtatgcaggtgaaaatagtttttattttgcaatcacaccggacaatttggatcaggtgaggcgcaacgtcactgaagctaaggtcaagttccctgcaaagcaggccgaactgctgaagcttcttgatgaaatgggtgaggatgacaatccgattattgccatttacaagttaaaaaattgaaggggagctatgatgggatgggctggcaaaagactacttaattatgagatagcagtaaataggcatgtattgcgaatagatacatcagattaagcacctttcttagttgttaaattggcgagtatctcttttatgtcctgtttgcgaatttattagaatatagagtttctttaaattctattatattaaaaatcagttagtttgctctatttgttttgggcgattagaagacttgttttaacacactgttaaaacaagtcttttgatgataaggaacagctcttttaaatgcaaaagacttgttctttgcatcctctaaaaagatattttggaatgactgttaacagtgttaatttgaataaaagaatttgataccttttttgaatttcaccaaccggaattattcgacttattgttgatttttaaaaatataattgtatttttgaggatgggttcatggtgctgatacagttaaaccatttgttagattgcctgcttctaatttacgggggtctgacatgtgatactatttaattcttataaattagtataaatgaaatcaagttatctgtttgttgggatattttggggctcatgtacaaatctgccgcaagtcggagtgaaggtggagaaggaggaaaaagctgttcatgcagattctatctgagaaatactttatacattttttaatagatttataatgaaaaacctatattggattttagtgcttagtgcgttggtggcctgtaccggtagttctcaaaaagagaagccggcatgtgtaaatactcctgtcgagccgttcaccggattgcctgtttttgatttgcaggggcaataccccaagaaagaaatcattcttcaggatctcgccgatgtaagatatgccgtgctggaaatcggcgacagctcattggtcggtacccgtcccatccttatgacggacagctttcttgttaccgtaaacaagaaaagtgatgttatcttctttgacaagtcaggaaaataccttcattcttttaaccgtacaggcatgagcggggaagaatatggggatattgtcagcggttattgcatcgatgaaaaagcccgggagatattcatctatgacgggttacaaagcaggattcaggtgtatggttatggcggcgcatacaggcgcacgcttaaactgccgaaaaaccgcatgtttgttttttcgatatttgagtatgatgaaaatttcctgtttggcgaagattatcgctttgtcgactctcaggatgagaggtatcctgtcaataaaacgccttattacaagatttccaagaaagacgggaaattaacgtcggtttccatcacggtcaaggagagaataagggatggactttatacggtaggggacggtgagtctggcggctatgtaggtttattcatgtctcccgtagcccgtttgggttcggatattctgattgccgattattctttggatacggcgtatgtatatcgtgatgaccatttgattccattgactgtccggcggaaccatacaagcgaaaacaatattccgattttagcgacggttgatgtgatgaccggccgttatctgctttggtacacgatagtaaaggatatagatgtgaaaaataatcatgtgtctgatccggtaacttatttgtatgacaggttcactaatgaatattgccgggtcgatctggtaaacagggatgtagtgtccgctaccaatattccggcattccaaatgcgattgtccgccaattatcatgtagtgcctgaaaactatgccatacaatattatccggctgaggagctcatcgaacttaacgggcaaggaaagttgaaaggagagttgaaagagattgcttcaaaattgaatgacgaagataatccggtgttgcttatcgctaagtttaaggaataatatttatagtatagcctttggtagaaccactgaaaaactaatgctttttctaaattaaagaatatgaaatcaattataggcaatggattgataaagtgtattgcttttcttcttttgcaagctactgccttaggcagttgtacggaaatatccaaaaagaatgaagagtgtgcgagagctcatttcacaattgatcctttagatagaaagatagtgcttcccgtgttatttaatgatagcattattgcaaatttggtatttgatagtggggcttctttgggagcttttattgttgactctactttttgttcagttcacccttctatcttatcgaatttgtctcctgacactattgctccatatgggtgtgcatggtctgtatcacgtatgcccgcatctatgtatacaattgttccgactataaaagtagggaatgccaatttgatatatgataaaatgttagtttataatttgagagattatatgggaggtactcaattggatggtgtgtttaatattccacaaaatgatactgttaatatatgggagtttaactttgaacatcattatatggctatccattcatttcaagattttattatgcctgagaattgtattctgattccttttgtgagagggaatgataaaagctcacttttttatgttaatctgcctttaaatattagatgtgctgatggagacacactgatgcttactcatacttatcttgtagatacaggtatgccacaagacatagctctgatggcccaagcttctgaattgccttttttttctaagaaaaagaatgccgtttggacgcaggcaccatctggatattatagtcatcataatgtaaatgctactttgtttggtggcatacaactcgattccttgcggatttatatatttgatcaacctaatcaagtaccttgtgattatcttattggtctgaattttcttaaaagatttaatgtctttttcgacatgaaatcacaaagattaggtttgcagccaataaagaactacgaacgagtggtcaaccctcggaagaaacgattccacatgtcatcccgtataaatagccatggaaaaattattattactaaaattgccgattatgaggggaattatgttaaagaatctggtttgttagaaggtgatgaaattattgctataaatgaaattcctattaaaatgatctctttggaagaggatgcggagctaagccggcaagacacattgatatacgatattgtccgtaaaggtaaatcttataaaataccggtggtgattgatagaaatgagcttcaaggtgattgaatgaaatgataatattaacgtgagctcgatacaatctcagaataatcttaactgcccgtcattgacaaagtctacatcaatggcgggtttcttattaaagaaacaatatgctgtaataaccgacaaggtatttgcgataaaattgttaaatgatccaccggatagatatatacttttccggaaaaagaatagggctgtcctattctttattttacttattgttgatttttaaaaatataattgtacttttgaggatgggttcatagaacttattttattctttattttggattatatttgaagacagatgaaatcatcttatatctgctgcgtattgttatttgttttgtttttggtaagttgcaccgatgggcgttccgaggggcaagtagcccgtttgttgcgtcaggccgaaacgtgtatggaggaatgtcccgatagtgctttagtatatcttcatcaaataccggatccggaaaagttgacaggagaaaaccaagctgattattgcttactgttgacccaggcaatggataagaatgatttaccattgagttcggattcgttgatacaaatagctgttggctattattcaaataaaggtgatgcggagtgtaaagctaaagctttattttataagggtagggtgtttcagcaacaagggaacttagagggtgctacactcctgtataaaaaagcggaatctatgattccggatttgactgattattatttagtaggattgatttacagctatctgggacatttgaatagggatgaagagcattataagaaggcattattttattatgaaaaggctttgccttgctatcgaaccatacaaaatccaactttgacggcttccggattacaggatatggctaagatatctgtctatttaggagagacgcatcgggcagactctctttttagtgaggttttgtcttatgtgccggatattgatgctgcctggcaagctaatatttatcataatgtgggtgtcttttatatgttcaccaatcaatttggtaaagcggaacaagtagtgaacacttctttgaaattaccaagtactccggaggacaaactccgttcatatgccgtattggctacaatctatacaaaacaaaatcgtggagatttagttgattctttatggcataaagccctgaattcagagaatatttatacccgaaaggcagtatatgcctccttgctgaacgaagctgtcagtaaacagaatcttcaagatatagaacactatgtgcctctttatatccagtctgcggattctgtttatcaactttcacaagcaaagcgcatcgtagaggttcaggctaaatacgatcaggagatattaattaagaaaaataaaattagccgattgttattatattgctttattctctgcttacttttacttgtgatatctttggcttacgtttttcatgtatacaaacgttataaaaggacgaaggagcgcgaacttattactcagagagcagagttggatgaagggaagcaggttataaaagagatgaatgatcagattgaacgaatccgtaaagaggcatctacaatgaaagaggattataataaaagtctgattgatttgactgatgaaaaaaagagcattgaacagcaattcgctctaattaaacaaagagctgatgatgtgagtcaaactaataacaaaatggaacaagacttacttgttttacaagaacagttgcggaaggttgatgacgctcgttcagaactattggcagaattggacgtttaccgttactttgatgctgagggagtgatttcggaggattgttataaagctgtggtcactatctataaacttttcaatgctccattagttgctttcctgcgtgatccccatttgaagcttaccccttatgaatcgcttctttgtgtactctcttatgaacatctttccacccaacaaatggaacaaaaattagggaaaagcaagaataccctaaataaagcaattttccgaataagagagaaattggacgcaaaaatggatttaaaaaagaatataaattctttgggagattttttgcggacgaagttctgacttaaaatattaatacctttttttatgttaattatacgtcttcgtggaaagatgtatttctgctttatggcatattatataggcgatttatatgtcttgtcgtggtctggtaacctccaaaataagtcctgaactgtttgtttttatgaaaacaaaaacttatgtttgtgatattaaccaatttctagtgattatgaaaagtatgctatttacattattacttgtagtcttgccgcttcaaatgatggcaaagacaaacggaagcacgagcccagttgatttaaaaggtttgtttaatgataagctccagaaatcgattgttgaagatattcccattagagctgaaatttcaggctctgaattcttggttcttagttttgaagctcctataatggatataaccattacactctataaagatggagtgatggtgatacagaagtctttgtcggtattttccggagatatagagacacttgatctaaccttttggggagcgggtgagtattctttgaagttgactaccccacgtgggactgctgtttatggaaattttcagttagagtaatagtgtagttcattatgcacaactctttggttagggagttagttcaggcaggacgttctacgtcctgcctcggacttaccaacggaaaaatggagattgccattgctcttttccgctatgcccgcctttccggtgaggcggcctgtgaagagatagccggtgagttgcttgatgaagtttgtgagcgtctggattattcaatgcctgtatcttttggtgacggattatgtggcattggttggggaattgaatatctggtacagcatggttatgtggaaggagatacagatgaaattctgaaagaaatagacttgtgtgtggtaaggaatatccatatctatgggatatcaggtctttctttacagaacgggatagtcggacttggtcgctatatgctcattcggattcttcctacgtttgtatcggtagatacctcttcaagtgcattgttgaaagagtatctcatttatttgattgattggttggaagaggaattgaaacattctgatgaatcggttgaagatttacttgactttttatttgaattgtatcctacggggttctatcgtacaaaagtatctgctttgatagactgctgtatgagtaaataaaaaagcttatggggtatgtcgcctatgttaccattgggattcctgtccggatagatagtccggaacggaaacgaaatcttaacattttgcttcggcatgtcacttcatccggggtgaacgtgcatgtactcgaagcgggagaaagaaggggctaacctgttggcggaattaatttgagttgataatatgtttggaaagttgcgcatatctacaaaagtaacatcacatttttagaatgaaagggggagtttatcgaatacttacataccagttgtgtaatttaataatttaagattttaaaatatggattcagaaaaggaaaagaaccggctttccgatatcgttctcgagagggtcggactcacggggaaccttctgtcagctcccgtttccccatccctggaaccagtggtggagataccaagtcatggaagtcaggtccgggcagggaaagtgacaggtccggaggaatacaagaggaggtttctggttcccgctcccagagccgctgagtggaagaccgcctacattgatgggagactgcaccgccggatcgccatgctggtcagggccgccggctgcggcagcatctccggttttatcatccggttgttggaactccatatggaggaacacagggaggacatcgcctccctgctcggtgaggtctaccgtccctgggatgaggacggacagccgggaggaacacctcgccgataaaacgttgtcattgtccaagaaggcatatcatgacaggaaagaacgtaaaagagcggattggtcttggcgggatggacgcggaccgcatccgtgagatcatgggggaagcgcctgcctgtccccggaagagacgtggaacgtccggtaacgacattatacgtcccgcaaggaaaaatggccccatgcaaccgtccgtctacggggaggaatacctgcatggcattgcgggcgtgcagcgtcggtcgctgcatattcccgccgccctgcaccggaaactgtccatcctggcgggagcctcgagaaacggaaaggtcactctggaggggttcatcaaccaccttgtctcgcggcatctggaagaatacagggaaacgacggacatgattctggaggagtccctgcccggccggtcataaaggctcgtcccccatgacaggggatctcccccgatgggagcattatttttgtttctgaaacaatagtgtttaacttttaatgaaaaagaagtatgatgaaaaaagaaaaagagttgttggttgccatcgccagccagaagggtggcgtgggaaaatccgtctttacggtactgctggccagtgtcctgcattaccgcaaagacgtgcgtgtggcggttgtggactgtgactccccgcagcacagcatcgccctgatgcgtgagagggacatggagaatgtcatgaaaaatgacgacctgaaggtgaacctgtaccggcagtacgaaagaatccgtaagcctgcctatccggtcatcaaaagcgacccggaaaagggggtggaagacctgcggcgttatatggacgaaaaaggggagactttcgatatcgtgctcttcgaccttcccggaacgctccgcagcgagggggtggttcataccgttgccgcgatggactatatctttgtcccgctcaaggcggacaatatcgtcatgcagagttccctgcagtttaccaaggtgctggaagaggagctgatcgccaaggggaactgcaacttgaaaggaatccggctgttctggaacatggtggatagaaggggacggaagaatttgtatgatgcctggaaccgggtcatccacaggatggggctgcggctgctgtcctcacacattccgaacaccctccgctacaacaaggaggcggaccctgtctgtaagggtgtctttcgttccacgctgtttccacccgatccccgtcaggagaaagactccggccttcctgaactggtggaggagatatgccatgccatcggtctggaggaatccgataccgagcggtagcggatgataggatacagacaccttgaataagggcttttagcctaagataaagtaagataattgcatgataataagttttttacagatgtgacttctcctataaaagcattaccttagtagtgtaatgtgcgccaagaggtcacacaagtaattgttcagcatcgtgtctgaacctattgttccatcaatagtagcctgaagaggcgtacgtgactggcaacggtcgggtgcgaagccctcttgacaacgacgttccaacctaagcatcataggcgaagaatgtcaaagctgactgatatgagtaacctaagtgaatcgccgtaccatcgtgactatgaattagctcacggatatttatgggccattccaaaaggcaagcagtcaggatagtacgctgttacatcgtgctacacggatgtcgcactgctggtggataggcggagtctaagtcggtcgtcagttatttgtgcgaaacttggtaagcccgtatctctcccgtcagccaataaccgatgggtggccaattgtaagagcggccgaatgaggtgcgggtaaaggattgtggagaaagcgaatgccatggtgtaatgccctggataaaggtttcaacgtcaccctacgcgaaagcgggcagacttccacagggtaattctttgtgaaacgaattgtagaacttcaagtataaagaaacagcaaaggaacaaggcgcaagccgagtgtgcatcttcagccggacgcaaaaccgtgtggaaaggaatagacttcgcacgatgcgaacgtaaggtatcaatcgttcactgactgctatgttcggtattaatgcagactgaatccttaatcatttatccaaactcttgaaatatcaaagcctgatttaagtgcagataactgatagagtttggataaatggaaagtttgaataaaatacattattatcaatttctacagatatttttccttgcgctcacaccccactgcatatttgagaaaacagaatgatttaacatactatttttcatatccaatcttttttaatactccccatgataatactcactataaaaagtccaatcgaataattttacgcggtgataaatgaaattaatagaaagcgattacctttgaagaaaaagtctgtaatttggtcaagagaaaagtacaataggtcaaaacatggatattataattcgctttatttgcactaccattttaaatctaattgtattaatccttattataaactttaatatctgcactatgaagagaaaagtactattaagcacattgtttctaatactacatttcactgtagcattagcacagcaagtaactatttcagggcaagtgttggatgagaagagtgaacctcttatcggtgccacgataaatatcgaaggtaccaccaatgcagtaatcaccgatttagaaggaaagttcacgataaaagtacttccttctgaaaaactggtcatcagttatctgggatataagcccaaaactatcactatcggaaagaaccgaagatttgatatcattctagacccttcagtcacagagatggatgaggtggttgttgtaggctatggtagccagcgaaaaagtgatattgcaaccgccgttgcttctgtgaatataaaagatattgtaaacagtagttctacgcagacgttgcaagcactacaaggcaaaatcagcggagtacagattatccccacagacggttcattgtcaagcggaatgactttcagaatcagaggtgtcaactccgtcacaggaggaacccagcctctcttcgtcattgatggtgtaccaatgcctactcaacagatcaccaatgaagataccgaaacggtaaacaatcctctgctgggactgaatccaaatgatattgaatccaatttgaattattggaatcctcgtcctatcaaaaaggataatccatatttgaccgtccaaaggaagctctctccacagactgtggaggatttcgccaatagactgttcatctaccaggtaggaaaaaacaatcatatcggctttccattccgcaaaccctcccagatggaaatccttaactttgaaatgaggaactattttgcagagaccaataccaattataaagcctttgccacgggtggtgacaaggcacaaagctgttggatggccaattttgttccttttgacaaggttacagacatatatctctttgaatccgctattgacgcaatgagtttctacgaaataaaccattatactaaagaaaccacatgcgcattcataagcacggggggatatgtcaccaaatcccaaatagagaatataagccgtatattcccatctgataaggtaaagtggaattgttgctatgacaatgatgccagcggtaatggttttgacatcaccacagcatattatctcaaaggtgaggaatgtaaagcttttgcaaggaccaacactggagacacatataagaccatctatttaagtttcccggatggaaacacacagaccttcaaagaagatgcattttcctccggcgagtatcttaaacaacatggtatagacaatgtaaatatcatcaaaccttcacggtacaaagattggaatgagcttcttgtctattacaaaagatttgatttgaacctgggtccaggaatgaaattcatcccggctatcgaaaagaccatatcccaactgaatctaagaggatatgaacaattggccaatagtatcagttcttccacaaaagaactggtggattctctgcttgagcaagccaattactgcatttccgcacctcttgccgagagcggcgcttatactcttatggtagactgtaatatcttcatggggctggacacgatggtaccggtaccaagcaacttatatgttatagaaaagtgcacgcaaaaaaagatatcggcacatgccataaatgaatttcttaaaaaagaatatataaacatttttagagacatgagttcatctgatttcaaaaattttctagagaaagacatcctaacttatacaaagggtgctgtagaaaagaattttgagaatgtgatattgactttcggatggagccttaaaccttcaattctaaaaaaaaagagttttgacttagaacatggtatatagcataacaatacagcatgataccataatagtagctgtttcaagcagacatgttgtcacaattcctgccaggtttaatggaatgattctcgggctttggaacttgatacagattttcgttgcctactgtaatgagaatccgaattgggtgagtaatgtccggtcactgtgggatgaccgattcaaatagggacaggtatggaacggatgcctattcatgcccctattatagctgacacatggacttttatacattcttgcactttttaagtgggtaaaaaagtactatttgtattttatacaaaaaattgtttgcttaatgaaatggaacatacattgccaatgatatttaatacctatatataggtattagatgcgtttttatacccaaaaaaatggtatttttataatcttttgtaatatctaattttgcgtcctaaaatagatcttttatcgaagagagatacagtttccttatatttgaactggggcttctgtaaagtgcgataaatatgaggctggaacggagctatcagaagaattttggagaaaatccgttttttaacttagttagatctatcaatgaaaatataagtatttatctgcgttgtattaagatatagcatatcagaactacaaccatcccgtttttatttagatttgcagtttgcttttaatcactcaagatccgtattactatgtatggaacttaaataaagtactaatatatattggattttcctaaatataatgcagttgctatattgttagacaacagacggttgaggtctgtgagattatgcaacggcaccaacaaaaacaacatgtatttttaataattttagttttgttacacacaatggtttgttttaatttaaaatttacatataattttgcattattaataaatatgatgttacttatgaaaaaaggtattttggggtgtaatattatatacttgtttatacttatttgcataggaattgccctccctatcaaatcgcaaaacaattacaaagtaaaacttacaggcactgtttatgagtacgaccacaacaacaagcgtttgcctttagaatttgcagctgtgtctattcctgaaattgcactagggacaacctctgatgaaaatggtagatacatactggaaaacgtacctactggtaaaattcgtatgcaaattcaatatttgggcaaagtctccattgacaccttaataaatgtaaataaggatttggttcttaattttacaatgaggaatgaggattttaagttgaaagaagttacagtaactgcaaccaacagccgttcaggcaaatccacatcttctcacatttcccgctctgctatggaccatatgcaagcgaccagtttatatgatgtaatgtcattgatgccaggtggaatttcacagaatcaagatatgagttcggcacaacagattaacatccgtcaagtttccagttccagtggtccggaagctccgatgaatgctatgggcaccgcaataattcgtgatggtgcccccatctcaaataatgctaatctatctgcgatgagccctacggtattaagtggtacggaaacacccgcttcattggccggaggtgcctcgccggctggtggaaccgatgttcgtagtatttctactgaaaatatagagtctatacaaatcgttcgtggtatcccttctgttgaatatggtgatctgacctcaggagcagtaattattaatacaaaagctggtcgtgagccgctacgtgtcaaagcaaaagccaatcccaatatctatcaggtgtctatgggaaccggttttgaacttggaaaaaagaaaggcgctttaaatgtaagtgcagattatgcttataatacgaataatccaatatccagttaccagcactatcagcgtgccacaacaaagttgctctattcaaatactttctttaataataagttacgtaccaattccagctttgattttatttatggtaaggatcaacgtgaacgtaatcctgatgatgaacaaactaaaacagcttcggaaggccgcgatataggttttactttgaataccaatggtacatggaatataaataagggctggttaaaaacactacgctatgtattgtcaggtacgtatatggataaagacagttattatgaaaccgtatacagttctgctacatctccttattccatgaccactacaaacggtgcggtacttagtaactttgcaggtcagcatatctatgatgccaatggtaatcaaattactaattttggaccggaagacataaatcattatgctgtttatctaccaagcagctatttgggacactatgagatcgatagtcgtgaagttaatttgtttgctaaagtgacgagttctctattcaaggcgagcggtcatgtaaacaaccgcatcttgattggtgcggatttccggagtgacggtaacgttggtaaaggaaaaacttatgacccaagtactcctccttatcgtagtcaatacggtcataattcatctttccgtccacgtaactataaggatattcctttcattaaccaatttggtgcatatgtggaagataatttcaaatggtccataagcggtacgcatgatttgaacattcaggctggtgtgcgttatgatcatacctcagtagtaggaggcattttctcgccacgtgtaaatgcatccattgatttgattccgaatctattaagtcttcagggaggttacggtattgctgcaaagatgccttctcttctctatttatatccagaaaatgcatattttgaatatatcaatataaatgagcttaccaatgaaaatattccggaaagccagcgcttgtttatgactaccacagaagttcggcaagtagataactcagatttgaagattgcccaaaatcataaagcagaagtcggttttaatttacgagtgggtaaaaccaatctgaatgtaatagcttataaggagcgtctgaaggatggttatgtaatgagccaaaccttcaacaccttcaatacatttatctacaatgaataccagcgcacagaaaacgggatagagcttagtagtagcctaccggtattgtctacttatgcaaaaccaactaataatttaaatatagaaactaaaggtttagaatttgatttgaatatcggacgtattgatgctatccgtacggccttccaaataaatggctcatggatgcgtactaagagttggcgtcagggttatagcttctatgacaatagcgaagatgctgcttcagcccgtaaaccggtggccatttattctcaagaaggcaatgcaagttacaaacaacaatttgtaacgactttacgtgccactcacaatatcccgcgtatcggttttgttgttacgatgacagcacaagctatttggcagcagtctaattggaatacatttggaaacgattctatacctgtgggctatttagcattggaagatgcgtctgtaaatatgtttcccaaggggaaatataccactacccagcaagtaaaggatgcaggatatggatatatgttgaataatgtaagtcataataatgctataaaagaatcatacagtccttatttttgttttaacttgaatgtaactaaagaaattagcaatatgctacgtgtttctttctttgccaacaatatgttcagaagttatccgcgcagagaatccaaacgtaatccgggttcatatattcaattgaataaccgatttttctttgggctggaattatcactcactttataatgtttaggaagttatgaaaaaatatttaatatatttgtttacattggcaagtacccttttgataggatgcgattcgttcagggacatgtctggcacagcagaagtgaatcctatcacagtggatgtatatttggatattaccgttgaaaatatatccacactgaaagatctgactgtaaagttcgacaattacgatgaagatttacattatgtaaaagaagtaactgataatagtgtgaaagttgacggaattatccccggaatttattcggtaacagtatccggtacagcgatcgatacagaaaacaatgaatactacatcaatggcaattctgtaaatgcggcattatttaagcatggtagcgcattgaatattgaagtacaagggcttaaagtgagcccattaatattcaaggagatttattattgcggtagccgtccggaaaaaggaggagtctatttccgagaccagttctatgagatatacaataactctgctgacattttgtatttggacggtatttatttcgcaaatttaactccgggtacagctaccactaaattacctatttggccggaagcggacggtaataattatgcatatggagaacgtgtgtggaaatttccaggaaatggaaccgaatatccgttagcgccaggtgaatcttgcatcatttctcaatttgccgctaaccatcagttggacatctataaccctcaaagtcctatagacggcagtagttctgagtttgagtttaatatgaataatccaaacttccctgaccaggcagcttatgatatgcaacatgttttctaccaaggaaaagcagagatgggaagtataccacaatatttgacatccgtattcggaggtgcttatgtgatttttcgtgttcctgaaggagaagcttgggatccggtcaacgatgaaaatatgaagacaacagatcttagcaaaccgaacagcaatgtttattatgcaaaaatacctattaaatatgtattggatgctgttgaagcagtaaacaatgagtcaaagatgaatgcaaaacgtgtccccggtgtacttgatgcaggtattacttgggtaggagctacttattgcggtttaggtattgctcgcaaattgtccacagacgaagaaggtaatcctattattcgcgaagaaacaggtacatatatatatcaggatacaaacaacagtacggatgactttgaacgtggcgttgttcctgtaatgcgtcgtaatggagcaaaaatgccttcatggaatcacacattgtaataattaactaaaaagacagaacaatgaaaaaacaatatatgaactatatgaaaagctgcctgctggtaatgatagcctgccttgtaagtatggtgggagcggcacagggcttctctcccgccgctatggaacaattgaaaacaagacgactatggtctcattcacagaatgctgccggtatgccattcgatgatattcagaattattcgaatgttatattgggatatgacttacaggacggaaactattgccgtccgcaagaggggcagaaagaggctatcgtaggtgtatccagtgaaggctttatcaatctgaaaaatgcatatgtgtggggagcatttaattttgcacaaaaaaatctgacagatgccggatataacgcctccattgccgatccattcaggggaatgccttactatgtcgcagaccagcacttaagcaaatggagaaatcaatattacgatctgaagtttcgtgcagctactcctttacttggtaatcattgggcattggggttggaaggtaattatgtagctacattagctgccaaacagcgcgacccgcgtgtggatacccgtttttatacgctgggactgacgccggggattacttacaagttgaataattcacacaagtttggtgcaagtttcaagtatagttctatcaaggaagactcaagaatgagtaatgtcaactcttatgtggatcaggactattatatattatacggtttgggaacagccataaaaggaataggcagcggtgtaaccagcaattatattggagaccgtttcggtggagctctccagtacaacttcagtatgccctctttcaatttactgcttgagggcagttacgatgtaaaagcggaaactgttcagcagagctatacgactcctaaaaaaatagccggtgtaaaagataaaactgctcatgtttctttaacgatgattcaggaaggaaaggactataccaattatatgagaaccacatatacaaatcgtaacatcgatggtattcagtatatttctcaacgcgataactctgaatcacaaagtggctgggtggaattatataataacatccgttctacgtacaaggcacaaaccgcttctcttaattatgcattaagcagaaaccgcgggaatgaatatagttggaaagcagaattaaatgtgaattataccaagcaagacgatgaatatttaatgcctaattctgtacagaatgcagaaaatttatctttaggcttaggtggcaaaaaaaattttgttttaggcaatagtttgaatcgcaggcttttaatagatgttcatgttgcgtataacaataatctgggaggtgaatatgtatatggtggcagccatgcagactatccaactgtaaccgaattacaacaagggctgactaattattatacctgtgattactatcgtattggcgggtcgataacgtattcgcaacaagtcagagaaaacagacgtatgaacttatttgcaaaagttgtattcgatcgtgtaaatacctctgactatgattatgatgggcgtactcatttatcgataagtttaggatgtaatttttaatgctacataacgaaatctatattacaaaacatgcgtaaattaataactggaagtttgatgctctgcagcatattatctctgcgggcacagacatttgttaaaccggctgtgaaagtaaaggacacctcttttgctgtaattacagataaagggacatttcaggcttgtgaagccgagcttaaagcctatcaggagattctaggaatggaagggttgcctacgttcatcgtatacaatgaatggaataaaccggaagatgtaaagaaagttattgttaagctctacaaaaaggataaattggaaggagtggtatttgtcggtgatatccctattccaatgctccgcaaagcccagcatatgacttccgcttttaaaatggatgagaaaaacaatgactggagagattcttcagtgcccagcgaccgtttctacgatgatttcgacctacaattcgattttttgaaacaggacagtgtcgaaaataatttcttctattataatttggctataaaatctccacagcaaattcggtgtgacatatattctgcacgtgtcaaagctgttgataacggcgaagaaccgcatgcgcaaatcagccgctattttaaaaaagtggtggctgagcaccagataaacaataaattagaccaattcttctcctatacaggtgatggctcttactctaactcattgactgcatggacaccggaaacctttactattcgcgaacaaatgccgggcgtattcgataaagagggacgggcccgtttcatccgttataatttcagcgattatcccaaggacgatgtcattaatatgctgaaacgcacagatctggacttgtctatttttcatgagcatggtatgcccgaacgtcaatatctttccggtagtcccgctactaataggtggaatgctcatgtagatgcaatgaagtactattatcgtggtttagcgcgtagaaagcaaaacaacaaaaagtctttcgacgaaatgctggatatgatgaaaaacacatacggtttggacactacttggattgcaggctatgatgatcccaaagtaattgcagaagattctttactagacctgcgcaccggtattatcctgtcggaagttacagagtttaagcctaatagccgtatggtaattttcgatgcatgctataatggtgatttccgggaaaaagattacattgccggacgttatatcatgtcggaaggaaaatgcgtaactacttttgccaattcagtcaatgtactgcaagataaaatggcaaacgagatgctcggcctgttaggtatgggagcacgagtggggcaatgggctaaattgacgaatattctcgaatcgcacattaccggtgaccctactctacgttttcaatctatcaatgaggtagatgccaatgctttgttcaaagaaccatatagcgagtcccgcatgttggagttattacagtcgccctatgccgacatacagaattttgctttgcacaacctttatcgcaatgactatccgggtatttctgatttattaagaaaaacttttgaaacttcctcgttcatgatggtacgtttcacctgcttggcattgcttgagaagattagtgacaaaaacttccgggaagtcttacacttggccattacggattcctatgaatttattcgtcgcacctctgttcgtatgatgcaacatgtgggactgaacgagtatgtttatccgcaaatcaaagcctatgtagaagacaacctatccgagcgtgtggcatttaatgtgagtttggggcttcaagtctttgatcaggcagccgtacaggcggcaattgataaagtaatggctgagacctatgtgttgcaagacaaggaggagatgcgtaaggttttggagaatgccaataatagtcgtagcatgcaaaaagagttattaagcaaagaaacttccgaacgttggcgcatcctttattgcaattctctgaaaaatcatatggcacatgcctgtgtagacggcctcttggctttacttaccgactccagtgaaagtgaaaagctaaaaacctgtttattggaggcttttgcttggttcactcattcttatcggaagcctgacatccttcgggtatgcgatcaactgagaaaagataagagcttatccgagaaccttcgtgaagaagccgaccgtacatattacagacttaaaaattaattggccatgattaaaaaaataatatatctggcatttcttttgccattggcaggaaatgcacaaacaacagtcataaagccattggtcaaacaacctaccgcttttgctatcataacagataaccaaacttatgcaaataccaaagatgccatgcatcagtacaaaactgcggttgaagatgatggtttggcaacttatctgatcagcggtgactggcaaaatccagatcaagtcaaacagataatcatcaaaacatatcaagaatgcccttcattggaaggtctggttttaatcggcgatgtgcctgtcgcattggtacgtaatgcgcaacacatgactactgcattcaaaatgaatgagaaagcctttccttgggatcagtcttccgtacctaccgaccgcttttatgatgatctgaacttaaagtttgagttcatcaggcaagactcagtaaatcatcagcatttctactacaaattgacagaagacagtccccagcggctaaatcctactttctattcagctcgtatcaagtatccggaaaaaaaggaaggggataaatatgcggccattgcctcatatctgaagaaagctgctgctgccaaggcagataagcataatcaattagatcgggtattctcattcaatggtgcttcttacaattccgattgcctgattgtatggatggatgacgaaaaagcttatatggagaactttccattagcttttggtcgtcaaatgggattcaaacattggaacttccgaatgaaacaccctatgaaatataagttattcagcgaattgcaacgaaaggaccttgacttatttatgtttcatgaacatggaatgccaacagggcagcttattaatgatgaattggcatgcactgatttcaataatcgttataaaatgttgaagagtacactttataatgcagtcatgtcccatgttggaaaacgtgacaaagacaccttacgtattcagatgcaggaaaaacgacaagtgaatgaggtgttttttaaagacctggacaatcctaagttctgggaagcagactctcttcactacgctgatgaacgtatcgtaacggaagatttaatgaagagaaatctttccactaatccgaagatgataatgtttgatgcgtgctacaacggttcttttcacgaaaacgactatatagcaggacaatatatctttaatgacggtcagacattagtagcacaaggaaatacccgtaacgtattgcaagaccgctggactattgaaatgattggtttgttgtcccatggtgtacgagccgggcaatacaataagctaatcgtatcacttgaaggtcatttgtttggtgatcccactttccgttttgctcctatcgaagccaatactttaagtaccgatataacaatacacaaagatgacaaagcctattggaagaatttgttaaacagcccatacgctgatgtacaaagtttggccatgcgtatgctggctgacgccgatacccaaaaggaattatctccgttgctcctgaagaagtaccgggaaagtggcttcaatacggttcgtatggaagctatcaagttgttgagccgttatcaggacgacaacttcatcgaagcattacgcgaaggtttgaacgatacttatgaaatggtagctcgccaaagtgccatttatgctggatttgtaggtgacgattccttattgcccgctattgtggaagcattggtcgaacataatgaacgcttacgcgtacaaatgagtgccaacaaggctttaagcctttatccgaaagagaaagtagaaaagacaatagaagacttttatgcaaaagttgaccgtttgaatgaaaacgaagagaaaaaacgattactaagaagcctggaaagaatgtttgtacaagaggcaaaagtccatcagaccttgatggatgtagctgcaccggaagcaaaacgtatcagtgcaatccgcaatgtgcgtaactatacattccatttccacgtggatgattatttgaatgtaattcgtgatgccggtaatccacaggaagtacgtgtagtaatggccgaagcattaggttggtttactaattctgtacaacggccacacattcttgaagaaataaagaagatgcaacaaacagccaatcttccggaagatttaaaagcagagcttgaacagacaatcaaaagattaagtttataaatatgaataaatacatccttttggcaattaccgctttgtgcttacaggatatgcaggcgcaaacagttgtacatcctagtataaaaacaaagactacttttgcaattgtagtcgatcagaaaagttatgatgaagcgaaaagtgaaattgatgcttatcgtaccagtatagaaaaagaaggtttaggtacttacttgctaattgatgattggaaaaggcccgaacctattcgtgagcaacttgtcaaattgcatgagaatgagaaaacgcctttggagggttgcgtatttataggtgacatccctattccaatgattcgtgatgcacatcatctatcttcggctttcaaaaggtctcccaaagccaattggcagaaatcaagcgttccttccgaccgttattatgatgacttcggattaaaatttgattatattaaacaagacagtttgatacctgactatcattatatgacattgcgtgctgattctaaacagtatatttcaccggatatttattcggcccgtatccgtccattacatttagaaggtgagaaccgttatcagatgctacgcgattacttaaaaaaggcagttgccgaaaaagcaaagcaaaatgcatttgaccaactgactatggcccgtggccatggttacaattctgaagatcctttggcatggagcggtgagcaaatagccttacgtgagcaattgccgcaaatattcaaatcgggtaatacagtgaagttctatgattttaacatgcgctatccgatgaaaccattatacttgaacgagattcagcgcgaaggattagatgtcatgctattccatcaccacggtggccccaccatgcagtatatcaatggctatgaaaatggttccggtattaatttgagtattgagaatgccaaaatattcttgcgaagcaaagtgccttcatacgccaagaaacatgggcgtgaagctgctatcaaagaatatgccaagcagtatggggtgcctgaaagttggtgtgcggaagctttcgatgaggagaaaataaaatcggattccattgtaaaccgtaatatggatatctatactgaagatattcgtcttttgactcctaatgcgcgttttatattgttcgatgcttgtttcaacggttctttccatttggatgacaacattgtaggctcttatatattcaataagggtaagaccattgctactatgggatgtacggttaacaccattcaagataaatggccggatgaatttctcggcttgttagctgccggtatgcgcatcgggcagttcactcgttttacctgcttcttggaaaatcatctgatcggtgacccgacttttcacttcaccaataatgccgggctggatatggacatcaaccaagctttagttgcgcaggaaggaaatgttacattctggaaaaaacagctgaattcccctatggctgacatgcaggcaatggcgctccgtcaattgtcaatggcaaattatagtggtctcgttgagttgctgaagaaaagttaccacgaatcgaactatttcgttgtgcggttggaagcattacgcctattagctttgaactatccgacagaggttgccgatgtattgcagacagccatgaacgacagttatgaactgatccgtcgttatgcggtggaatacgttgaaaagaattgcaatccggaattgttgccggcatggatagaaagctatttattacgcggacatgaaaaccgccatcgtttcagaatttttagtgctatcaacacgttcgaccatgatatggctttgaatgaattgaagaaacaggctgccgattggtctttctacgattcttcctatgtgaatgaattgttagaataccttcctcgccaaaagaaaggacttgaaagagattttgcacttattgacagtccggaaagtactaccaaacagatacaaagcgaaataagtaggttccgaaataaacctattgctaaagctattgagccattactgaacattataaaaaatgaaagccaagaagaagaacttcgcatattggctgctgaaacattaggctggtataatttatactataataaagcagatataatcaaagaacttaacacatttagaacttccaatcaaaagctaatgaacgaagttaccaaaacaattaataggctgaaaagtcaaaataggtagaatcatccaaacgatgagatagaccggatccaaagggcggttctgccattcctgagcagcctggttgactttgttcgtgatgatggaaatagctgatgtggacagttctatctcatagatttcacgcatctcctcttctatgtctgacacgctcattcctttggcatatagggagataacaagtttttctttaatattatcgacactatacagggacattcagtaaatgtctatagtataactcctcaaccagttccagacaccaatcattaaaacagggatattcctaaaataataaaatttaaggcaactaattcattgcgagttagttgccttttttgtatctttaagcattccccccaaaaaacggtttgacggccaaaacgggggtaatctaaaataaaaacacatggtaaagatacaaaaaatctcagaaatcgaacctcgtttaggttttaccgagttcgatatgctaaaaaaatatcgtcaaagttttgcaacgagtgaattaggtcgcctccatgctctgtttcctttctcggaactggcccgacaaatgcatttgaagtcctctgctttgggtcgtaaaagttatttttctcccgaaggtaaaatagccttgatggtcttgaagtcctataccaacttttccgatgcacaactgattgagcatttaaacggtaatattcattaccagttgttttgtggtgttcagattgatccgcttcatccactaaccaatcctaaaatcgttagtgcaattcgtcaggaactagcgcatcgccttgacgttgagcccctccagctcattcttgccgagcattggaaaccttatcttgagaaccttcatgtctgtatgaccgatgccacctgttatgaaagtcatctgcgttttcctactgataccaaactcttatgggaaggtattgtatggcttcatcgtcatctgtgcaaacattgccagaccttgcacgtacaacgtccccgtaacaagtatcttgatgtacgccgtgcctatcttgcttatagcaaactgcgtaaacgcaggaaatcacagactcgtatgattacacgaaggttacttcagttattggaaaattcaatactgccaacagataatccaaatgatcgcctgtcataatataacaggcattgttcattacataattgttggcatcatatgcaaaagccatttggtttccgattattttccatacaatttttggcttagaaaaatcctcccaataactgatgctatcttgtgtttcaaaccactcgttactagttttctttcgggcttttatttttttgccattaacaatatgagtttctcctgtttgttctaaacgctctatgccaattgacagaagataatttttcaccgcaggataactttctatatcataatgccgcgaaggaaatgtggctataatccacaagtccgcccattcatattcatatctcttgatatccctgccacgaagaatcggtcgtataagttcagccgtccgaacacgttcatcttctgtttgacaattcgctagtatctcatcacgcttttcggtagaaatgataaaagtatcattgaaaccagtttttatcccatagttgatttggatgttccaatccttcaagggtattcccacagactcaatcttctgcttgatgctctgttcaatgggagacaatatcacccatgggatagaatctgcaaagttacacttcacgccttgttgctgcacgaaatcgctcaaattattcaagccattcgaatcttgtaccaaacaagcttgtgtgttaaaaatatttgctgctttttgagataaaagaatatttgcttctaccgttattgcatcgaatatttttatacctgcaaaatctaccaacataataggattggtcttgcttgcgaaataacctcgcaaggcttcaccataccctgcacgcatccatttattagacgtgatatagcaaagaaaaccattgggagtaagcaggttcatacccaactcatagaagaggcagtaaatatcaccagtgcgtgcataagttatgtaacccatgcattctaatacatcggcactcttacccatagattgtaactgaatgtaaggtggattgccaatgatacagtcaaatcccaagaagttgccttcggcatcgagtacttctggaaactctatacgccattcgaatgcaccaagataaattttgttggagcgtatttcctcaaatatattttctaaagtcgcaatttctttctttaaatcggcaatgcgcttgtccgacgctttcttttccttttttgtcggttcaaacagttgaggcgcttgtaagtttgccaactcagagcggcgtttgttcaatctaaccaatcgtgcatcccggcggttgctctctgttttcagtttcgacttgatttctgttataaacgtttccaaatcctgcttttcgcttttactttgggcatttttatatttagctatagcctccttatattggctgatgctgatactagactctcgcagtacggtctgaatactgtctgtcaaagcgaatcggtgaagcaaagaatttccacatttgatgttaatgtcgatatttggtaaggtttctaaataagtgtaattactttcagccgtatagtaagcattcttcaacaattcaatccacagtcgtaggcggcaaatcttcacagagttggggttaatatcaacgccaaataaacagttctcaatgatttgacgcttctccttgaaaagagtttcctgcatgcggcgactttccgcattgagtgggttgtaagcaaataaattaccttcggtatcggtaacaatcagctcgtcattttcaatggcaagttgatagtccgctttgcggatacgcttaccggtagcatctaccaaaatacctaattcgtatttcaagagtatcagttcattgagagcagacacaagaaagtgacccgaaccaacagctggatcacacagtcgcaaactgttaattagttcattagcttcgactatattgtcaatatggttgtatagttctatacgggtggtacaattccagccataataaccattaaacttttgcaacacggtcttggtgattgcttcacggcacatgaacatagtgataaagcctggagtgaatactgaaccatccttgtgaccatttattttctcgaatataagccctaaaacagaagcattgatgagtgttttagcctcttcttgcacttcttcactgccttcgctcgcaaagttataagcgtcgagaaaagcaaacaaatattgcagggtgggtaatgcgttgacttgtagattgcgttttttatttcgtaatacgctactcgccaagacaggaagtaccgtacgttgtgaaaggctgtttatcttaattgttttactttccaaatctgtcacctcgaaaagagaactgttaagatagggaacgtaagcaaaatcacgcataatggagtgtgtgcggctgcccatgtcacgtgcaagcacttggaaaaagagtgtgttgagatcatcatagtcatgaatcttagttattgaaagaaatttatagattgcatctccattgtggtatttcaacatctgagcctccaacagtttcaagaaaaggatacgattcatccaagtaatacacaattccattgcaacattgaataaccgttcctcataatcattcccatacaaacgaccatttatgtgacgcaaacaatcttctgcatccagttggttaatagtattctctagtaatgaagcctcgtcacgccgttccacagctttgcgtacaatcacggttttattattctctttgcgttcctcaataccaataatgtgtagcagctcagtgtagaatccacggttgagcgaattgctgtcattttggaacgatagcttcaaaagatgtgtatcgctgaatatcttataaagttcgataagtttgcgtgaagcgctactgtctgttctatcaagcaggtgttgatagtcttgtaagttgaagtaagtgtattcaaggctatctttcacctcctcaatataggttgttgcaatttcagtatagaagaaatcggttttgttactggttttgcgtccatccacaaagtcttgaaactcacgacgtaattgtttgttctgatagaatttgcgttcaaactcatgggcatcaaaaataaagaattcatgaatattagtagcgatgagatatttaatatcattgttcttcttattgacacgttctttaagatagtatagcaataattcctgcaaagccttacgattaagattgtcattagaaatcatctcacctttgttggtggtactctttacttcaatcaataaccctatattggacttgatagttttatccaatcggatagccaaatcaatatcttcttcgggagccatgtagtatggcttgtagaacgtttcactcagaaaattacgtaaatgttctttttgcgtgtgttctctttgcccatccacaatattgtctctcaatgtgcgaagggcatttttgaataagtcaaaatctgttgtttcaatcgcaacctgtctatatgctttgttcaaaacttgattcggtttgagtagtcccataatgtttggtaaatgagttaataaaatacaaaggtagtctaaaaacttgataataaagaatgaacgtattggtttaacgaaagtttgttctactgccagccattatcaacaaacaatagcagcagtagatttgacatgattctacttattatattgtaatagccagccaaagtaatcttttcacatccggatctatcacaggttggataagttgttaacctgaaggtaaccgacctgatggtataggaacaggaagaagtctgtaatcatggcatttacccggatagagaagccacattttttattgccggacttccggcattgcctcatccatgtgtgaaaaggagttttttctttcaccacaacgttcctttcacatacccaaagggggtagtggatccagacctgcttcggctttctttttccttcccatatgacaaaaaccgactatccatgactattcctgctagtgtgccggtcgtgcttgcctctcatggtttcttcccttatattcgcactgatatttaaacgagttgaaaatatggaaatatgctacatcgaggccggtgtccttgagaggatgctggcgcgcgccgagaacctgtccgcacgtgtggacagattgtatgagagaaaccgctgtaaggaacccggagagtgactggacggccaggatgtctgcctgcgccttgacatctcgccgcgtaccctgcagactctccgcgataccggacggctggcgttcacccgcctccagcgcaagttctattacaagcccggggatgtggagaagttgatggtctacgtcggcatcagacgcaaggagaaggaggtgagagaaagaaggaagaacggaaacctttaaagagcggaagagatggaaggcattatcgacaaggagaacgaacgtgtccgcaggttctttgccctgctggacgacatggagaaaaaagtggaacgtcttgcccgtgacaaccgtcctcccttcaacggggaacggttcctgaccgacagggagctttccgggatgttgaagatcagccgcaggtgcctgcaggattacagggaccaaggacggattccctatatccagcttggcgggaagatcctgtacaggcagtcggacatcgagaggctgctggaggagaactatcaccctgcattggtataatatcgtatttaagtttaaggattgtcgccggaattgcatttacgattccggcggcagtttttatttagcctgcggcttccttgccggccgcgggctttcttctttccatcagccggttcatgtccgaggatatcttccggtcggtgacctgggcgtagacctgcgtgctgtcgatgttcgtgtggcccatcatcctggcgatgctctctatcggaatacctgcggtcagtgtcagggtcccgaacgaatgccgagccatgtggtaggacaggttctctttcatgcctaatgccacgcccattccatgtacctcataccagaggacgtcgcggaccggcagcgggaataccggcctgtcgtcatccgtggtgttgtaaagctccagtatctgtccggctatgggatgcagcgggatgaacgcctccacgtccgttttggcgcggcggatgcggatatactttcttccttccgaagtcgttccgatgtgacggggatggagagccctcgtatccgcataggccagaccggtcagcgaggagaagatgaacgtcctgcgtgccagctccatcatcgggtcgggcagcggggtttccatcatccgcttcagttcactgcggctgatatgccttagtttaggtgtttctttcctctcgtatgccacgtcctctatcggattggctcttagtatttcccggtccacggcgatgtagatgagccggttgagccagcacaggcagtggttcacgtgtccgttcctgtgtcccagctccttcttgagaaagaccttgaacgattcggcgaactcctcggtgatgtccgaaaaggcgatgtccttcatcccgcgggattcgatgaactgcctgaggttgagctgggtggtcttcgactggcggtaggtggaagtggagttgatctccttggagcggaccctgagccgttcgcgttccacctctccggcctgcaggaggtattccggtacggaattggcgcctgacacggtggtcttgagcagttcggccgtgaccactccctggttcctcagcaggttcccgtacgcctcttccaaccggctgcggaaggcggcaaggcggttgttctccctggctgttttgatttcacacttcttgctgtcccagtccccgggtttgcaatagacgcctgtcgtgactgccgatttctttccgtcgatgctgatccggcagaggacggcggtcgtgccgtccgatttcaccttgttacggttgatgtagaataagagcttgaatgtactgcgcatgataatgattgtttagggattaaaggataagtttcaaatcgcgggttgcctcgacgaacctgtccatgtcctcgaacagcttcttcggggttacgcgcgcgtatatctgggtggtctttatgttggagtgtcccagcattttgcagatggtctctatcggcactccctcctcgagcgtgaccagcgaggcgaaagaatgccgtcccatgtggtagacaaggtcctggctcagccctgccatcaggcgcagggatttcatattggccctgagcgtgtggtagtcctgcggcgggaaaagagtctcgcgggtatcgtcccggtatttctcaatcaacgcgacggcttccggaagcagcttgacacgtccgaggtagtcggttttctttcgctggtatttcagccagaggctgccctcgtcatcccggaagaggttcttccgggtgatgcttaccgcatcggcataggcggtgccggtgtaacaggcgaagaggaagaggtcccgggtgatgacatgtgacctgcgtttttccggtatctccagatcacgcagcttctcgaaattctcacggctgagtgctttcggtgttgtctccttctgcttgggcagcttgaagtggcagaaatggtatttctccgagtggccctccttgtaggcgatgcggcagatctttttcaagatggccaggtagccgcgaagcgtgtccacggcatatcccttttccagaaggatgaaatcctgatagtcgcggatgaactgctcgttgagctgcccgaagacaaggtccggaaccttgaatttcgccttgatgaattcggaaagcgtgcggtaggtgaagaggtaggtcgagagtgtggtgggcgcacggtccacaccgacacgggccttcatttccccgttatgccggtcgagaagtttgagcagggtcatctgcatgcccgcattgccctggaacatgtccctgaccgcggcggcatcgaaatccctttttctttccatgagggaattgaaggccgagtgtacggcaagcagcagtctttctattttttcattggtctccaccgcttcccggctcttgccgttcagccggctctcacgcgcgttccacagcccgggggtgcaggagagcttgcagctgaactgcgccatcgtgcggttgagggtgatccgtcccatgatcggggctttgccggtcttgtccggctcgctctttttcaggtagagcagcaccttgaatttttccactttcataacgctcttttttaggttgtaaaaatactcctttgaaaagcgtcctttggcatgcaaaacattgagaaacagtgaatacaaatccgctttgttcttatcggtaaaaattcggttacctgccgtcgtttccgaaacaggcggctaacagtctggtaactgaaacgtcgcaatattttgttttcttttgcaggtctgtctgttctgcaattctcgcaaaatgcttaattataaacgttttacgtttaattatcgtcattctgttttttattgcatttctaaatattacttacactgcccgccatacgtgggccacggtcgcttttcatcaggagactcccgtaggagttatcagccgtgcgttgggacactcctcggtgaaggtgaccgaaacttacctgaagcctttcggggatagggaagtagatcggacaaacaggaagataatccggtatgtgctgaatgcggtttgaaaaaacgaaaaatagagtgtattatgcttgtaatcagagaagtgtatagaccgttactttgtaggtaacggcaatgaattattgctgcaaaattggatattatttttcacacaaacaaataaaaagacaagttttttataaaaaaggcaattaattttaaaaaagatgcatgctttgcattagttttccctattttctcctaaaaaaactataagaggggttggccacgtttactgttatttaacgcggatgattattctattgccatcatcagatgttttttattatttaaatctcagtgtcctgtcaggaacgctatccgaatctattttatgttaattgccgttacctacaaagtaacggacgatcacacaacaaaacaaaatagcttatgcttacgccgttaactttgacagccatatctgtcttgcgtcatatttcccttcaggaaacagtaaacttccaggaattagaaggtagttgtaagcctcttggcgaacttctggggcaattggaatccgcagggctgatacgtgtcaaggcggatcatgccggtgatgtcactccggaaatctatgagctgacccgtcccttcttccaaatctccctgctccatgtaatggaagccacggaccaacatctgaattgcaatcaaccggattgtgagaaaatgtacgcacgctatcaccgtgccgcccataagttggggatcatcaaccagatgccccgcgtctacctgtcggagatacctctgaccgatttatgaacggattgccggtttgtttcagataaactaacagaatgaaaaaacaactattcatattgcttttgcttgtttcgggcaacgtgctggcacagagggcagcagttaaaaccaatttgctgcacgatgtcgcgaccgctccttcgcttgccgccgagtgggcgttggcctcccgatggacactcgatgtttcgggaagcgcctgtccgtggagctttgagaacaaccggaagtggaaattctggatggcacagggggaggcgcgctattggctttgccaatcgttctacgggcattttctgggcgtgcatgccggagggggagagtacaacctgagccgggtgcgtctgccttttgtctcccattcggcctcttcccgctacgagggatgggcggtgatggcagggctttcatacggctactcgtgggtgctgggcaaacgctggaatctggaggctaccgtaggcgcgggatgggtacatgccgagtacaaacgctttaattgccctgcctgtggcgaatatcggggagcggataagaaaaacttcctggcaccgacccgtgtgggcatcagcttgatttatatgctaaaatgaaaagttttatgaaagagaagatacgatcgacccgtttaagaatatgctttcggaaggctttggcgtcagcctgttgcctggcggcctttgccctgtgttccggcatgccgtctgcccgtgcggcggggccgtccggaggagtggcccttactgctgtccgaatgcagcgtgcgggtggacaggtatatgtctcgtttgccataaagatagccccccgcgcagtgcgtgcccgtcaccgctgggtgattaccccttgtctgggcaatgcctcggatagtatgttgctcagcccgtttgtggtgacggggcgcatcatggcacgcagggcgaggcaacaacgtctcttgaaaggcagtgccggtgaggcgggtcatcggctgaccgcccgcaatggagataccttcttgtataccgatacgctgcgctatgctccgtggatggagagtggcttgaacctgcggctcgacatcgaccgggaaggttgttgccgggtacagacggtggggagcgtcgtttcctccggtgcttttccggtggctttgccctatcgtccctcggtttgtgaggttgctccgcaggtgagccggtcggtagcggaacatgcggctgactatccgttcttgtgtgaggcgggcagccgtcccctgcgtgaaagcggcatcggtattcgtttccgtgcggcgtcggcagtggtggatacactatactcggccaatgccggaaatctgcgccggataacggaagccatcggattgctgcgtgcggacagttgcgcatccctgcaaggtatctcgatcaccggatatgcttcgcccgaaggagcgacggagctgaaccggaagttgtcggcgaaacgtgccgaggctttgcggcatgctctctcgggtcgtatgaacctgcctgtatcgttgtttgaactgaatgccgggggagtagactggggcaggctggccgaactggtaaatgaaagcgacatgacgtataaagaggaggtgcttgccattctccgcagccatccggaggaagaacggaacgacaggctgaaagctctggcgggagggcgtccgtatcgttcggtgctggatgtgctctatccgcagttgcgcgatgcctgctacatccgtgtggagtatgccaaccgtcctgacagtgtggcggatacggtgaaccgtgcgatagccgccattcgggtgcgggattatgaagaagcattccggctgctgaaaacagtagaggcggacgaacgttcgtggaacgtacggggagtatgccatctgttgtgcggagacgacaaagaggccgggatatggctgcacagagcggcgaaagccggaaaccgggaggcggaagaaaaccttaaaaagatgaatgcggaacaacgggccgcgacaaccggtataacgcaataagtgtatcacataatataaaaagaaatgaaaagactaaagtacatgagtatgatggggttggctgctttgctgctgacaacctggtccgcctgttccgacgatacggacatcccgggcggagagaatccggaagaagcgagagcttataccacagtgaccattgccgtgccgaacggcgtggcggaaacaagagccggtacgacggcagatactgacgatagcactactgaagccggttcggaggatgaatacaaagtgaagaccgccaacctgtatttgtttccgggaggagcgagtagtagctttggtagcgctaagttgaaagagattatttccatcgaccagtttacacaaatgacagccagcactgccgacgctaaaacgattgtatggaccagtaagaaaacagccttgacaccgggagactatcgtatttacattgtggtgaacggtacggtcaatggagtgactgacggcagcaagaatagcttgaccgaagccgatttccttgcaaagacaacggctgacgctacgggcgtgatagctgctgtgccggaggccggactggtgatggcgagccgttctcccaaaagtgataatatgaatactcttccttatattgcccagacgatcaccaaagatccggaacaaaccattgcggcaacggtagagcgtatgatgggaaagattacggtgacggcgggaggagccaatgtggcttctgccgctaatgtgtataccagcttttctaccacagtgactgctatcggcaatattacgaatatcaccctgacaggctattatgtagtcaacgcacggaaagagggatattatttccgtcatgtggataaagaaagcactgcaacgaatcctttggccgaggcaaattatggtaactcaagcacttcattgccgtatgtggtagatccgaaaacgtatagtaaaacttacgccggcacacctgcagctttagccaatagctatgccgactggtatctgcaaggatcaggcgcattcagcttgtcgtctttcggttcttttgggggaagttatacggatatgccgggctattcttccagtgcggcagaaaccaaagtcgccgcttactgccatgaaaacacgatgctgaaggataaacagaagaacggatatacaaccggtatcgtatttaaagcggaaatagctccgagtaaaatgatgcaaaaaaagactggtagtggtggtgtggaagagaactccacatttaccagcatgtctgaaatcttctatcattccggcatcttttacaaggatattgcagcgctgaaggaagccggcgtattgctggcggacggaactacttccagctctgccagtggtgcccctgctgacctgaagaagaacgacgtccagtgcttcaaaaaagggagtgccgatggcaagttcgtttgttattatccgtattggatcaagcacatcccttcggacgatgtggcagaagatgtgatggagttcggcattgtccgcaacaatgtctatcaagtaaccgtcaccggtattcaaggtgtgggcaaagacggtgtaaccgaagatatcatcaccgataccgaaaccgatgatccgaccaccgtattgctgaatgtgaagttaagtatcaaaccctggatagtacgcacgaatagtgccgtattgggacgttaacccactcaccacagagggcacagagaacatatttttctcttcaataccctataaacaagagcttaaaactctgtgtcctctgtatcctctgtggtgaaccccctgttcaatcataaaattttcccaaccatgtccgataactttcagacctcctgtttctcccattccggcagtcggcttctgccgttcttatggttttgcctgttggcgggcttatccgcctgctcgtggaccaaggacgatcgcggcgactgtcccagtggttttcgtattcgtcttcagcctgcattgcatgcacagatacagcccggtagcgggataggcatcatcaccgacgagattgacacattgtccctctacgtgttcgacgcacagggacagtttgtctgcctgcacactgaaaacaggcaatcgctgactgaaaacggatctatcattaccctgccactggaatataaagacggagatgtttacgaactggtgttctgggcgggaggggacaaccggcattaccggataccgcagctcacaccgggcagttcgacccgtgacgagttggtcctctggctggaacgtgacggggacggacgtcaggatgacgaactgggacacctgtggtatgggcatgtccggttgagccggatacagccttcggaactgacatcggtcagtgtgccgatgctgaaggacagcaaccggttcatcatcaccctgcacgacacttcgggcgaggggctggatgccgatgattatgactttaccctgttggcggataacggtcacctgaatgccgacaacgagataataacgggcaaccgggtgacttatgccgcctaccatacggagtccgcgtccgaaacggaaccggcggtcacccgcacgggagaagtcagcctggcacgtgcccgcttgaatacattgcgcttactggcagggcaggaggcccgtctggtggtgactgaccgcacctcgggacagaaagtagtggacgtcgacctgacgcattatctgctgatgacgcgtcccctgtttgaagagagcagcggtgtggagctcagcgaccaggattaccttgattacgaagatcagttcaacgtgattttctaccttaccccgatgggaaggctggaggcgctgaacattaacggatggattatcagactgaatgatgcacaactgtaaaggcagcatatttaccttgttttttcggtttctgctctgcctgctggcatgtggatgctccgatgataccgatatgccgggcactccggcagagacggatcgggtgacggcgtgtgtccgtttctcggtgcgggtggcgggagcaagtacccgggcggccgtatcggcgggcgaagcggttgaggaaaagatctcttctgtcgccgtttttctggtatcggtcgacgggagcggaaacgaagattggaatgatgtgcagtacgaagtggtttacggcgctacaagtggtgcgacggacgtgtatcaggcccgcataccgactgctcccggacggaagaaggtctatgtgggtgccaatctgttgcccggccaggtgcatgccatttgcgggcaggcgggaggcctgggattgtataccgctgccggagacggatatgacgaagtgatcggacagtttgcccgtcaggcggagggcattgccatgaccggaaaagccgccgatgccgtaacggtcagtgcgggtaccgatgtgaatatagatcttacggcctcgcctgtcgcgctcgaaagggtggtggctaaagtgctgctggtgtgcgatacctatacggacgacggaggggcgtatgtacggatgtccgacaatgcggctcgtccggcggatgatccgggctggatccgtttgtcggaagtgcggtatgccctcaatacggtgaaccggaaggtgtatctgaatgcgccttcggatgggaaagatcctaactatgaagtagacccgtatgtggtaaaagatggtggcggcaattatgtgtcggcacccgatgtgcctgaacagcaattcgcttaccgtaccttgggcagtgtctgggcagaaggtagcgctccggaagcgtatgacgccccccggtacaatgctacgaccactgtcccctcgacaagcggcgcttataccggtggactgtattgtccggagaacacgactgccacttctaccgcctctcttgaaggcgggctggatctggcaggaacactcagttcaacccaagcggagattccccgcctggtggctacccatctgctggtagcggcgaagtttgtccccaaacagattattaccggggccggaaccacgcaaaccctgacatctcctgccgatgccggtacttacttgcccgcaacgacgacacttgccgaggcggaagcacatgcggcaggcacttactttaccaacgggagtgactattacagctatgcgggcatgaaggccgccatcggtgcgggtaccctgaaacgtactgattttgccgcttacgaaggcgggatcggttattattacacttatatagacggtgcaactgctgccgacggcacaattgctttcagtacggattccggcattttgcgcaaccgttattatctgctgcgtattacccggtttagtctgccttcggccgctttgccgcaaccgatgcgtgccacgatgaaagtaacggactgggtgacgagttcgggtaatacaatcacagtcaggccgacgtagaaaggaaaataaatatgattcaccacagagcgacacgaagttttaatctcttgtttatagggtattgaagagaaaaatatgttctctgtgccctctgtgtactctgtggtgaaagctgaaaaagaaagcatacaactatgaataaagaagaaaaaaagagtagattctgccgggcatgcctgctgctttgcctgtgtctgttgtctgcctcgtgtgcatccggagaaggagagtacgaacaggagatacccatggaggtagctctcacccgtacggatggggtggcaggcagcgaaagcactccgttactgctgttctggaaagagacggatttcagttcggggacattgggctctccttataaaacctccactccggcaggagggatcggtgattacgccgatgcaccctataatacggaagtggactatccggctgataactcccgggtggtggtgatgggactttgcccttcggccatgactacggcagatggtcacggcacctattcgttaccgtcttcgggagcagggctgaccgatgtgctggttactccgaatggagttacgggcagcaggaagcaacctttcggacgggcgttggagttcgcgcatgccaccgtacgcatcgtgctcaaggcaaggcgtacggacaacacggtcggtaagctgtatgtcaagaacctcaaattgacagtaccctcacggttagtgtgcggaggggtgaaatgggatacgggggtgaaacactatgtaggggctccggcttccgccgatttggttatcgatcatcccggtcagatattgagtacggaggatacgcagattgcggtattctatctgataccctgtgcgaggaacgacttgctgaccgatatttcctctttgggtacaccagggcttacgttgacagcggatgtggccaaggatgtaaattttacgaccggagcgcgaaaggcaagctttcctgttttggatggcaacctgaatttcatggatcaatccggagtcccggtaactcagttgcaagccggagagtcgtatggaaccactctcaattttgatattgactcttttacgctggaaggcgaagagaaagagtggggggatggaggaaaaatgaccattcccgtggtggttcctgaaccggttccaagtacatagatgaacggtgaacagggaacgatgaacaagggaggggctgtaaacttaaatactctaactctgtgccctctgtgtcctctgtggtgaatctaaataaaaagagctgaatatatgaaaacaataatacgattctttctttcaaccgtagccgtgactgctgcactggttaccggctgcactcccgaagaggaacacatacctgcgcagggtggtgacagctttacactctcctcgagtgaagagcaggccatcacccgtgcgggagatgtgtcggtgaatcattttacagtcggcactaaataccggctatacggacttatagggagttcgtggagcggcagactctctacgatgaatgggcaggagggtacggaggtcgtggatgcggacggcacacatcagatagaatatctgagtgcaggtactgacgaagaccgttttgaaggccgaatcctcgacttttatgcactgacatacggtaatacgactctgccggtatgcggttccgaagcagatggcgtacctgtttgcaacgtcacttcctctgccggaggagtactgcccgacttgcgccgtgctgtgctgacaggacaatcgggtatcaactcgggagtgattaccttacccttcaagcatactttgtcgaagttgaagtttgaggtggtgaagcaaaagccggaaagcggttcaacggatacggatgtattgcaagatatccggttgcagggtatctctgtcagtgattatagcgaaggagcgctcttgctttcgaccggagaatacagccatacgggagggaaaagtgaccgtgcggttctgggcagcggattctctcaagatgtgacggaaagtgtgcagtctgtaactatagacgggcaatcgggcagtgcggctgccgaatgcctgatattcccgactctgaccacggctgcggagggacttaaaataaaagtagctacgatgggaacgaacagtggaaatcgaacggatgcatatgaaattcgtgttccggttatcggagatgacgggaacgttcagaaaaatgaagacggcacaaccgtgacggagcctttccgcttcctgcccaattacgagtatacactcactattacgatcactaacagtgatgtacagattattactattattccccgccggtacgattggatcgaacatgatgatgattcgcaatatctggggcaacccctgacttttaacggcctaatgtggatggaccggaatctcggagctaccagtgcggatatgacaaccgccgagggatgggaaggagccagaggatatgtgtatcagatgggaagaagtattccatattatctgcctaaaacagtaaactataggggaagtgacggagtgacgcgtcaaagacctaaaagtatggttgatagagacgggggtgcaaaaccttacccacagatagtgggacatgaaaacgatgctcctgtcgggcggcctgcggtgggaaccttagcgcttaatccgggagatgtcggtaagacatttagttacgttatgatcggtggtgattgggataatactgccgctaccagttctacttattggaagaacacaaagaatgacccttgtccgacgggctggcgcgtgcctactaaggcggattttgatggaattatgcctacggcagagaaatatggcgacttgacatttgcaaaacatagcggaacgtcctggagggaagttgcttcgaatgacccggaggcaggtgcccgaacagtttatgtatgccaacgggcaagtggtgcaccgtatggagtcatttatgcaattaagtatcagggaacttcacaagcttatcgcctgatgtggacggtggggatggttggagacaatcagtctgtaacggattatggaacacgctatcgcgcctatgttacaatctcgaggtttccatgtgataaagatgccgacctgaatataaatacctgtaatacggattatgattgggtgcatcccagtgattttatcaatctgcctgtttccggttatatttatcccaatcaagcggtactgtataatgccggtgctgaggtagtatatgcgacatcgacccctaacggtgcttatatgtatgctgcttcgtttaaatatacgggcaatgatagtcgtcgctactttgcggtatatgacacgccaagggctgccggcgtttccgtccgttgtgtgcgggatgtcacttcacaataaaatggtaagtatgaaaagaatgattgtcttcaaaagttggttgtatgtaatcatggttctgctctgtacggcatgtgtccctgcctctcccgaagaggagaatacggaggaattggtacaggtgaatcccattgccggcggatattacgcttctatgcttccttcggtccgtacccgtgcaacggcacaggatagtgaaacattgcaggataaaccgatttatctgctggaagacgggagtacgatacgactggtggtatatgataataccaagaacttaatggaagagtattccaaagcctatctggtacgtaacgccggtacgtcaggcagcagtttgctttatccctgcgaggtagacgacgacgggacggtaatatcttcaagcagcactcctctttatatgaaggcgggtacttattacttcagaatcctgtcacctgccaaggccttaaactcaaagggttttgtcaatatcggtaatggagaatatctgcttgcgaccgacgaccggtatacgcaaacagccatgacagcggtgaccattacgaaaattgatgaagggggtacattgaacaatgttcagaccctgtatctgccccccatcatcaaccagatggcacggatgcagtttactgtcaaagcgggtgagggcgtacactccttggagatgcttgccgaaggaattgaaatcagtggcatacagcaaccactggacaatacaaccagttttgactgggtgaatggagaggtgctgcccgtgaaagtgggcgaccaaagtgcatcggtacgtatcacacaagccacccaaaatgccgataacagcctgatggcacataccggcatattgcccacagatgcacgttcgcactctatcagcgtgttgctgaatctgaaagtgaatggtaaccccactcagtatcagatgttactgaccggtttgtatctgacagcagggcattcgtataactataccgctacggtgaagatcagtaacggggtgactgtactgacctggcaaaaccgttcgtggacggaaaatgtggaaatggatacataagagctcaccacagattacacagattaacgcagatttataatttatcttgttgatatctacgattaaaagttctgtgttaatctgtgtaatctgtggtgaaatgaacaaattagagtaatacttaataatagtcccatgaaaagattcggatatatcgtttttagtgtttgtctgcttacgttgggtgcctgcatatcccatgaaccgatggatcaggaagaggacgtggtaaaagtgtcggttgggctcactgccgcttcttttaccaatgatgcggttacccgtgcggagcagccgatggcacccgattatgaaaacctgattggtaatttgtggattctgcagtttgaccgtgaaggtatcctgatcggcagtgaacagatagtgctgaccacaccggtgctcaatacaacgcttgaaggagtcgcactgagaaccgggcgcagcaccctttgcatagtaggcaatctgacagatgcggagactcccgcgtggcctgataacctgaatggtttcaaaagtctggtggtagatatgggctggatgaaagaacggagtgcggaccggaatgtatgtcttttcggctattatgaaggagagattactgccggaaccaccgctgtgaatgtggtattgggacgtctggtatgcaggctcaacatagctgtttcggccaagacggcaggagtattcagcaacgtgaaaattcaattgaagcgggcgcagaccaaaggttatctattcccttcggatacgtatctggcaccggaaagcggtgattatacggaagaggtgatcaccactgccggaacattgggaacaacttcttcttatcgttattattatatggcggaaaatgtaaccacaggaacaaaccgggatgaacgcacgcaactccaaataaaagcaacgaaaggggggactgagtatacaaaaatcattgatctgggcaggagtgatatcaatgactattctctccgccgaaacaataactacacattcaatatcattttagaataatcatatatcttaatcgtgtggaagctatctgtgacagacgcttccccttgcttgttttgtttgttgcaggtccatgctttcccggtggggaaaggtggacttgctcggtttatatcggttatcattcatattaaaaaattaatggggtagtcagaagaaatagcaattcaataagagaaaatagttgtttgtcgtcagtaaagcttctatttttgaggtgtaagcttataaggaagaatccgaaaatcctgatagtaaatagagtaggagactataattatattttatatgggactgacacagttaagaacaaatccgcaaacagtattgagtagcgaacatttttttgttgatacacgtaatttagttcaaactcctttaggatgtactgtacagataaatgaacagttgaagaatggagtgttttattgggacattgctaatcatcactcaacagatttttattttccatatgtgcagggcaatgccggatatgtggggatacaaactcctattcaggatggaacggttgtagtgacaggaggaatgaatggatgtgctttggaagtttgctacctgaatgataactattatttttatcatgatgcaaacgggagcaatatgcataaacaacgcaatgtgggaacacaggtatgcagaattgaggctgggaactattggaataataatatagcagggcaatcaacgttttatatacctaccattcagtttgtttgtgtttataaggcaggtttctggcatgtaggagcttctggcatttattatactggtaatgactttgcttctaaagaaataaaaggcgtatttgtgcctgagggaggaaagtatagaggttactttaatgatacaattcatctgattcaaaggtgatgattgctaataactgataaaaacgtgcttgttttcattgtcgctacgaaggattcgacagattacaaaaagaaaggagggctactataaggttcaagagtgtaaatgggagtatactggtaggattagtctgattgctatgtttgtggtgacaagagagggaagaatttggtctgctcgtaaacaaaatctcgtttcggacgttgttatttgtaaaattaaatcctattattgcagatgatgtaccttactattatagtcaaaattgtggtaggcatgctgggcgtgctcttctttcttcgtatctccggtaaaacacagatggcgcaactgactcctcttgattcagtcaatgcttttgtgctgggtgcgctcgtcggaggtgttatctatagtcccgatgtatcggcatggcaactcgttttctctttgggggtgtggacctgtttcaacatgggtattcgctatctgcttcgtttcaaaacgttgcgtcgccttataaagggagatacggtgatgattgtccgcaatggtcagatcaatctgaaagaatttaaacgaaacgggctggaaatggaacagttccgtacccttttgcgtgagaatggcatcttctcgatgatggatgtggatgatgtgcgctttgaaacaaacgggcaacttacggtatcgacctgcaattccaaatcggaatcgtatcttttcgtaaacagtggctcagtgctggattcttcgtaagtgttcggtgaactccccctataaataatcctttcattgaatacctttgccgccgaccctctgcttgtaaggcagatgctctgaaccagctgagctaaacgcccgtacactttccttttaaaagcgatgcaaaggtatcgcttttctcgaaatctacaaattatttacgatcttttttttcaaaaagtttccaacatgatcagtaagtctctgtttttcaaacaatagaatccattttgttttacttcgtttgttttctcagtaactataggattcttcttcaaattaggtggtaaattctttatttctttattttcaagttgataattgtcctttttgcttgctttaataggaaaaaacagacaccggctgaataagattgctcaagtctcggaagtgaatttacgccgtccggaccggtatcttcatccttatacctttcttcaattaacattgttaacgccttttgcaggttgtcaggttcttatgcgtaaataacaagtcttttgcatttaaagaacttgttattcacatccaaagaacaagctttaactctgtgttaaaacaaagtttttgaggatagaaatcttactttttaaagatattgattttcagatggtttattctaaaattcgctttttcatctcacggatggactcttcggaggaaagccgggatacttgcttttttatcaactataaacgagggcttacacttccgaaaactgaattagatttccatgagtaaaagaaaacttactaccaaattttgaagaagaacctaacttaggttatccgtccgatgcctgccgccgaataacacgtgcgggattgcctaccgccacacaatcatccggtatatcttttgtaaccacgctaccggctccaatcacgcaacggtcacctatcgtcaccccagggcaaatgaccgctccgcccccaatccagcaatcttcaccaataataaccggataagcatattccttgggattacggcgttccagatagtccatcggatgatgtggagtatagatttgcacacacggacctatcagtgtatgacttccgatagtgatgaatgctccgtcaaggaaggtacaattggcattaacaaatacatgttcgcccagacggatgccgtcaccatggtcacaatgaaaaggcgggcaaataacagaggtaggcggaaggtcgggcaccagctcctcaagtaactccctgtaagtatcgtcatacgtactcagtccccgcatctgtgccaataactttttagcatgctcaaaccgtacctgcaactcgggtgctgacatatcagccagttcgccactacgcattttttctatttcagtcatttggattattctgtttttccgttcgtaaatacatatttcttttcatccgaaagctgttcgttgaactcaaatccttcccaagcaaatgttttcaactggtcaacggattctatccggtttttcaggatgtaacgggtcatctctcccctcgacattttagtgtagaccactactgtagccagttgcccgtttttccagacgtgaaactcaggagtcaccacacggacctctctctccacccgtttccaatcaaaaagtccccgcatctcgtcactcgccagattacaaagtatcccaccggcttttttaatatcttctataaacaagtcggtaagaaccggcttccaatactcaaacatggttcgggtaccgggttcgggcaatcggacatctccttcgagcctgtaaggtcgaatcacgtcgagaggacgcagcagcccatagcaaaacgaagtcaacctcaaatggtcctgagcatatcggaaatcttcatccgaaaaatctttgggagaaagtcttttaaaaacaatcccggtataagccaacagcgcaggcagctcccgagtcgcttcggaatgaaagtcctgatagcgcttataattctcaacagcaatcttagcatttacccgcaacaggcgctccaactctccgacagagaattgagacatttgcaaagcgacctccgctgcctccttccggaagcggggaaatgtggtgagaggcgttttcactttcgaaacgtcactcatggttttggcgcaagataaaagtatcagcataggcttctttccttatttcaatgtttcaaaggaacaaaattaatagaaaaacgggagtatgcactttttttcttacttttgtactgtcactaaaacctgaaaaactaacattttacctaaaatgaagattaaacgactctacttactgggagcctggctccttttgggcgtcagtgcttcggcccagaacacaagtattcaaccacaaccacaacagattctttcggaaacgcaggctctgagtctgccggatacctatctgattgtcggagaaacagaagcaaacccgcatgccgtcagtgcactgaaagctttacttgccggaaaaaagacagataaggacggaattcgcatctatatcggtgaaaaaggggataaagctatccgtaaattcgcccggcaaattcccaatcagaaagaaggatattatttagctgtcaacgacaaagaaatcgtattggccggacaagacgaacggggaaccttctatgctttgcaaaccctatcacaactgctgaacaataaccaattgcctgtagttgaaatcaaggactatccttccatccgcttccgcggtgtagtcgaaggattctatggaactccatggagccacgaagcccgtctccgtcagttgaaattctacggagaaaataagatgaatacctatatctatggtcctaaagacgacccgtatcacagttcccccaactggcgtttgccttatccggaaaaagaggcgcttcagttacaggagttggtaaaagtggccaatgaaaacgaagtggactttgtatgggccattcacccgggacaagatatcaaatggaatcaggaagaccgtgatctgctgctggctaaattcgagaagatgtatgatctgggagtacgttcgttcgcagtattcttcgatgatatttcgggggaaggaaccaacccgaacaaacaggctgaactactgaactacattgacgagaaatttgtaaaggccaaaccggacgttaccccgctggtcatgtgccctaccgaatataacaaaagctggtcgaacccgaaaggtaattacctgactactttgggtgagaaactgaacccttctatccagattatgtggacgggcgaccgtgtgatttccgacataaccaaagatggtattgcctggatcaacaagcgcatcaagcgcccggcgtatatctggtggaattttccggtatccgattacgtacgcgaccatttgctgctcggaccggtttacggcaacgacacccagattgccgatcagatgtcaggcttcgtcaccaacccgatggaacatgccgaagcatctaaaatagcaatttacagtgtagccagttatgcatggaatccggaaaaatatgacagcgaacagacatggaaagatgccatacgcaccattttgccgagtgctgcggaggaactggaattcttcgccgcacacaactctgacctgggtccgaacggacataaataccgccgggacgaatcggttgaattacagcctgtagctaagctttttctcgacagctatctgaaaaacggctcgtataccgaagcagacttcaactctttgaaagcaaccttcggcaagatgacagagtccggtgatattctgatgaccaacaccgaaaaccaacctttgattgcagaaatgatgccctggctccgtcaattcaaattattgggtgaaaccggacaagaagtattgtctatggtcaaagcttacaaagaaggcgataactcactttttatccggaagtaccgccatgtgaaagcactgcaacaacagatgttccaagtggaccagacttataaccaaaacccttaccagccgggtgtaaaaacagcaactaaagtgatcaaaccactgatcgaccaaacgttcactacggtgaccgaacgctataacaagcaaaacggtacacagctggatgccgcaacggactacatgcctcacaaactgacgagtgacgtagagcaactacgcaatcagccgttacagatcaaaacgaaccgtatattggtatcgcctgccaacgaagtaatcaaatggggagcgggacgtacgttgaccatcgaactagatcaagcctatccgggacagagcctggatatagatttcggcaaaccggatgtagccgcctggggacgacttgaagtttcagccgatggcaaagaatggcagaaagctgacttcaaacaggaaaagaaccggatcacgcttaacctgaaacaagctccggtgaaagctgtccgtttcagcaataccggcaatacggaacaagaagtttatcttcgccgttttatcattactctggacaaataaaaacttattcaatctgtgtaaaaagccccttccggtattttcgctaaaatacggaaggggcgcacacaaacaaaacaaacaataattcatcaacagccttcacaggctataccgatgaatatcactaaagatagcatacaaagagtatgctcgtgaaaaagctgccttttcaaggctacagaggataagattaatcattcagcatgttcatttaccttcgtacaagagctttctctttcctgtaatacacgaaatttcatttgctgctgttcccgccagtagtaaaaacctccacacgaaattttgcataaaacaacatattcagttttacgcttccgcatcagacgcaatagaggtgtacataaaaacttatccggttcggaaacacgcaccctgattgtttttcgtccggaagtagttccgtccggacagggcaaccagtctatatcaagtatgcccagaagagaataacaataaaaggcagaatgttcataggcataccatgctccttcttcctgatacaggaaaatacaatcaacattctgtgcttctatttgcaatatctcttccagggtcatactaccgcaacgttctattgaataactactatcttacgggctacagtttccccgccggaggcggaagtcatcagtacagtccctctcctgttcgctccgaaagctacgtgcaaataagcatgcgaactatatttgctactgagttccgacaccataccgtctcccggaaatgctccgggagacgcggcggatgggtgcagaaagagccagccggcagacgtcggattcaatacccggaccgtccagttacggtcggttgaaccaaccaaatcgaaaacaaacgaatcggtatctttctggtccgatataatgggattccaactgacacgaaccggctgagacagattatcacacgtcatagtcaaggttgtagatacggcactattggccagtgaggtaaaatcccctgttattttatacttattacttcctaaagcctgtgcagacagattggtcagccaattacaatcggcaggtagggtcagaaccggctgaacaccacggctggaatatacggtacaaatatctacacccgtcgccgatgtagtcacacctgtttttccatataggctgaatacattattagacgatgccatacggtattcaccgtcggccacaatacagggcaaatccgtgtcttcatccgtcaactccacttttagagcattcgaaggtgcagaagccacagcaatatccggattttcatatcccggaccattgacgcccaccaccgtaacaatataacggtggttacgtacaatgttcaggggagccccgttattaccgttcatcactaccttatagtagccctttttccccttataccgggctgcaatcactactcccatatagtcggaagccgaacaattgcgctcataaatgtataaagatggttccgcaccattaacccagcccttacgataatccagataggttccaccggtaaccggatttgcggtaacgggagtgttaacttctcctgtgcaatcggtcggagccaggaagccatgacaggctccctgatggacggtaattccttcgatgacaaaatcatccagtccggtatttacacccccactacccttcttcacttgtatacaggcagtggaacgcaacagtttcacaccctctgctttcgtcacgatattgattccgttgagggcaaaacgtccccacatgaccaaaggcatcacatggtttaacaatgtgctctctctttcatccacatgttcgagcgaggctgtctgcaaagaagagatagccgcattttccgccatacccagagttatatcaccaaagttcaaacgatccgaagagccatcagcactccgcccgtttgcaaccagatgaatgatacgccgttccgaagtagcatccaaacggactgtgaaattaatccccgttccggtaacaaccaacctgtcattctctactttgacacgctccataaactttgcgtctttgtcgaatatcagcaagtctacgttcttaatatcggtatccgtatacaggccaccggcacgagtaagcgcattcactgactccggctgcggcaaggttaccgaaacagcaacatctatcttcccataagcgggtttctgttcctcttcctcatgactacacgagacaaacagaaaggcaaccagtatacctattatatattgtattttcatactatagcgcattttcattgtttacactaaaatctatttcctctccccctgataattatcggaataggtattcacgattacgggagtccagaagggcttttcttccggtcggaacggcacctttaccgaatgagatgagcgagtattggcaggggcagcagcaagtactgttacagatgccgaatgtttaatacggtcatatacaattgttgcaacttttgtataacctccttgatcatacgttccattacctccggtagtagtaataagtacccgataagtatcattatacaacctttcaccaccttcattataataattatatttattataatccccggtttcagcagttcctttagacattgttcctcctttataggcagtcatttcaaaagtcataggagcaggtgctatccctgaactataccatgttgcataaacatccaattttatttttcggggagagtttacatcgccttccaatacaggggtattaaaaaatgcagtttctccctgtccttgacgtgcatcaccaccccactgtagcagcagtttgccattataattaacagtctgattcttgctccatccaacaggctttttatcataagaagaattattacttccatcaccagatacattattaccttggaattcaaccgcaatatccacatcagacctatcccacataaatttaacaacaaaatagtcgaaaggaggaattgtcactataatatcctggtgtactttaaccgtaacctgataatccgggcaatcggcatgatggaaagttaatgatccgtcacgagcctcatcggaaggttcacggtcggttgtcatagtcagcacttgcgttaacggattccatctcaaatcactatgaatccaggactcccatgaatcgaaaataatatttctactaccacccaacacagtcacatcttgtgaattagtaactgcagtctgcgctgaacctgttggagcaagtgcatttattaccccatcatccacatggatatagcagttcattaacgaaatcgtatccgtatcaagcgttgttttattcttcacaacaatctgaccatctccataacaagtatcaaaatcatccggcttaatcgtcgaagtacgtgtaaagttgactgtggtatttcctttcaccccactctgtatgtctgaagtcgctttgggactactacctaagaatatccagtcacctccaatactcttaacctccaccgagcgattttcatgtgctttaggacaaaatataagtttatgttcactaactttgattgtacctctatccggtctttgtgtaaccggtattttcttggtcacattatttgctttaatggtaatatacgaagtacgcggatgattatccacatagctatccagatcagcagtaatttccaccgcattcccatccaactttttcaccgaagtaatccacgtggcctcaggtgccttctccactgtatattcccgggcattggtatttacatgtatcgtgtctttgaatgccagcccaacggaagctttatccgtataaagctgggtctgtgacaaatcggcttccaactgtgtatcttgccagttcaatatctcagtagagacatcgagctttccaccaaggaaaatgcgtaccaacaaaattccgtttactcgtggaacccgaggaattaccacatccgtcttctcgaaacgtgtacctccttcactggccagatcgacactcagtttaagatggctggtagtcgtgtctgtcggaagcgcattcagataatcagttcctttatgggccggcacaataaaccgaagcgtatcactatactgatgacccgccattgcagtattattatgtatagtaaaggtaccggtcataggttccgcactcacagtagggttgtttttattggggtataaccctccttcccaattaagagtcgtaggcacgttgctcaatttcatggtgtgggtaccattgatatccagtcctccggcatcagctatcacgactttgaccaatgcaacgttccgtgaaagtaatgctgtttcggaagcgacattatcctgaccggcaataacctgctgtccggtaatataagccgtacgcaactcaggcatagacggcaaatttccaccggaggaacgggtttcccacattttcagtgatgaacgcccctggccacggacaggctgaaccaattcactgtttatatccctgtcggcactgaccaacgtaatatcccacgtacctgccgcaaccggcatggtaagacggtctgcagcgtaagtcacatccggcactttctgcctgaactgtccggcagcagccccatctccatcaaacagatagacttgcgtattattgataatatcagcagaagctctcgtcatcctgaaaaccaatgaaggattaccattggttccccctggcgattccctgtcatccgtacaagcaaacgccagaaaaagcagcaagcccatcaaccctgtatatattctttttcctgtcatagttcttttttcatccattttcttctgagcagacaagaagaccttgcatttgaaatgcaaggcactcttatccctaagaatcattttatttccggatcgtaaactctgccatacgttctgcgtcagacacactgatcggctgtgcacccgtaggctggtttacagatttgattttcagtttcacctgtttttccaaagcatccgtactgaacaatactactccattcacattagccgaactatggttgccgtctccactgatgcgtaggtcatgcaggttggtaaagacaaagtcttttccttcttttgccgtagcatcgggcaatgtcacacagttaacaataatatcactacctgtggcattagtcagtaaggctccgtctgaagcacgcaacagcgaaacggtgaagaagcccgacaccacattattatttactctgtggtcgccaagtgaagttatggccaagcgtgccggctgatcaacaacaattccgctgcaactcagcaattcaccatcaaaagcgacattggaaccactcaggctatgtactttattgaaattcaccaccacggttttaggaagttcatagcgggtatcctccaatgttctgacattaaaagatgacttttgcgaaccattggcaaatatcactctcggcgtcaatcccatatcgaaatcaagcgcatcggctgtgccttctccataaatgccatccactataatattggctcccgttgcattagtcaaaggagttccgtcagttttgaacaacccaagttcatataaaatatcttttgagccttcttcgccgcgctccgtacgtaccaactttacaaccgcctgctgatcttcgataaccgcttttcctacaggcttcaccagataactctgctgaacatccgacaatagcaattcaaagtccttcacaccttcgatcagatcattcgcctttaccggaacctcaatatcctgtttcaccagatagcggtcagccgttccgcgtgagggagtgaaagagagctttcccttcaccggagtaaagttattggccgttgtagccgatgcttcgcgagtggcataacctacactcacaggaacaggcgctccctctttcgtggtggcatatccggtcagtgtcacagtaaacacagcggtggctgttccgtttaccggcttggttattttcacgtccgagacatagagtccatgtccgagcttgacaagacggctaccactacccagaaaaagtaactccccggatgatgcagtcaaggcctgacggtaaatggtaggtttattatccgtcacataacggtcaaactctttctcacctgtagcagaatacatacaaacccggccctcatccgaagacagcagcaacacttcaccgttgttagtcaccttaatcttatcaaagttaccatcaatcgttcggtcaaactcagcttttcctgtcggcaatatacggacaaatgttcctctgcgtgcgttgacgtcataagtggttaccactgattcgccggtagtccggttcatacccacacctctcacacttccgttcgaggtacccgagtacaaagctgttccgtcatttcgcaataaagcgtaatatcctttattaccactgcctcctactaatatattaccattgcgggccacccgtagatggttgagcgttgccaatccctggttggcaggtatcagtgttttagcaaaaacaatatcaccttccggacgaatcttataaataatacctccatctgtcgatgaattaccggtaacaatcaccgaaccgtcattgatattggcgttcaggcctgtcactataaatcgtttagccggaatggcagtcacataataaggtttccctttatcatctaaccggaccaccaccgtctgttctttttctctgtctccggagaaagccgcacaaatatattcagtcgtgttgcccaacacctcaaactggtcacaatagccacttccggtgttcttatactgataaatcactctacccgatttatctactttcaagagaataccttgccgaccgcttcctcctttcggctccataccggaaagtatcaatgatccgcttcgtagcagggcacctttcagaagctcgcttccttgtcctcccgcataaatattggtaacaatatgaccactacggtctaatatgaccgcccgtccgctcagcgtcacattatcctttctgccttttgtattcatcacagcagattgtccgacaagcaggatacgattgtcctccaactctgtcagctcattaacagcagtaaacccggccaacggtaacgaaaagagtacctcaccttctcttcctatccaggtcagattgtacttctgtccctctttgcctaccatagccacttcgtcaccggccaacgggcataccagttgtatctggttcttatcgccatatttcttatcgaaaaccaccggcatatattgggctctcacctgcagacaggctatgacgctcagcaggaacagtatccacactctatgaattcttgtcttcttcatatatcgtttacttttttatatttctacctcttattatatatttcgacacgccttgcccgacggttcacttgtatccagtcgatacctccctccggccagcgatgatactcaatttcctctttcacctcttccggagaaagttttatcctaccatgggcctgtataccgaaacgtacatttaaaccatgattgcgcaggaactctgcaacactctctgcccttcgttctgacaatgaatagttataactgtcacttcctatctcatcggcaaaaccatcgaacctcagttccgaaaaccggtaggtacccatttcattgataaactgctcaagcctccgtacagattcatcggtcagttcatccgaatcgaaatcaaaataaagagtcatcagcaaaccttcaggtgcatactgcttcaatgcaacagactccggagaaactgtttccgtagctccgttcaacaacaaagcgccacccaaaatcgcattctcctcactcatcccgtaaaagggcatcccctgctgagtacctaaatcttctaccgtacggaggtaataaatatcatctcttgaagccatctcacgatcggatacgaaataagcagttcgcaaatcgagcgggcacatataataatcgttgaagacggaatttaccggatggggaaaatgactgatactgcccggcactaccccatccttatcataataagcactgaacaggtcataaccaccgaatcccggcagcccgttagacgaaaagatgagacgtcctttatagattacaggaaagatctcatcaccttccgtgttgacatccggtcccagatttacaggggttccccatgtccgggcctcgtcatcccaatgaacaacatacaagtcgaaccctccgtatcctcccggcatgtcggaagtgaacaataatgatttaccttcattgaataagtaaggatgggcatacgaagacatctcctcctgtggaaaagccggaacgtacttcgtaaaccgtttctttttattctttagcacagaatagaacaactttgtacggaaagggcgtagtttccggtctgccatttccactgttgtcttctctttatcgtactcaatgactgtagctaccattgacttcatatccggcgaaaaggtcaccggaccattctgcaagtcagcaggtatcttccggaaatatccataatatctcggaggtttctgagcctcggcaccgggttcaccggtttcgtcaagtgcataatagtgagtacgatgaaagaacaactttcccggatcattgaatttactgtagctaatggcataaaacggctgctcaccataatttccaacccaaaattcagcattcggtgtattcagtgataaacgttttgccgaaaatccggggtcttcctgaaccgaatggcgcatggcaagtgcctctaacgtattctgataacgctgatagcgactatatatatccttataggcattatccaggcagatagcttctgctttgcgggcctgtccctgaaagcgcaaggcatctatatagtcacagacatcatctaccccgagcagatccggacgcaaccccattgctttatcataatgttctgaggcgcgaccgtattccctcaccataaaatacaaacgtgctgttttgagatgaagcgcagcctgactgtcctcatctttttcacgcctgatagccgtttcgtactgggccatcgctttatcaaatttctgcctgataaaattacggtctgcccgccgttctatccgccctatcttccgctcctgcgcaacggaaggcatagttcctcccattaaaaaaaggaatgcggcagccgacaggagaatctgtatcttcttctttctcatttcagcaactttttatcagtaacattagcggaatatattataagtaagatttacaccaaacttagtcggcccaatccatctcttggttttcttacgttccaaagggaaatttacatactctccgcccaaataatatttattatattggaggtgcgcatatcccagcccaatattcagatccagcccccaacgggagttgaaagcaaatttatatccggttgagataccacctgacactccccagcctttacgacgataactctgtaacggatcattatgcttcaacaaaccaatattaaagttaccgtacatggcataaggacctatgtaaaatccatcccacgaatcattagtatagaagttacgcggattcacataatagcgcaattcaacactgctctggagtgcccgaaacacttcttcatgtttcttgaataaatacggcatccatagcacttcaccgttcaccgtgagttgcctcgtcaatgtatactcaaagccaacgttaggcgaaccggtcagccaaaaaggaatattcactttgacactttgtgcctgtactccgctgattaagcaaaataaaacggcgacactcaaaatatgtcgtataactgatttcattctaattctcttttatatgtatatatgtatcattccatgtccgtatctccactctcgatatcttcgttccatcctacaaccgatatcttaataacggtataagattcgatttcaataattatacgtttaccatgcaataaccgtaacggcaatcctgtctccctttccgtaacttccacgggcaaatggttgacaactgctccattttcatcgagaaatgtataattcaacctcatcggttcattctccacagaaggaataaaacaatgatctacctctaatacatcggctttctcctgtacgggtaatgttccgaaatgaaacattttatcctcgggagtcaatcggccggtcagagtatcatttttgaggtattgcatcacaggtgctccttccgcaagcaattgtaccttctttatatgcgatacatcaccgggaaatttcttaaaccgaaccgttatacgtccggtatagcgttccagtgctgcggtatcggtctgtaaaatgcccggatgtacaattgcgggtacgaacttctggaataatatatccgaaggctgtacatatctgttcggtccggtagaactgcttttcagaataaaagcagaagcatccagatgttgcccgtccacaaacgtaagactgtccgtattggtataacagtatactttatattcgccgggagttaacctaaaactaaacaagcccgcctccatgcgcggatctttatcccatggagaggttgcataacgtgcgccgaccaatgttccggcatcgttatagaccagcactcgacaatcactaacagtcttgttcagaacctcgggtacaaaaacctgataattcgtttcatcttcaaaataatcatatgtacacgacgcaagcgaaagtaagactgctacaccagtaaataatactatgagaagtctgttttttctcatgttctatagtttatttcattatcctcccccaaggccctcaagagcagcaaacacaccttcttgcttcctgctcccgggctgtaattccaaggggagtaaaaagaaagtttttacattataatatctgaatttacaatattgctatcccaaggtgtaggagctcctacagtaattgtcaagccaccatattccgtaggagttacaggtacagtcgtgcttccgccggtacgtaaagtcagatttacttcacgaatcacattcggtacaaaattctctttaaccactccggaccaataaacggtagcatcactgggaagtgcagtaccatctcccaaaatatgtccggctttgccacgtcctgataccactataaaatactgacgctgtctgtcagccgtaccggtagttgcagaatcattaacgcgtccaccattattggggaatacaaccacatctctccacatcgtaaagtttccgtttaaaatcgttcctccagggttataaccggatccgggctcagccgttttaaagacttcaccatctgaaatagacaatatattagtagcagtcgaggtagcactgactcctccgtcattccctgccatcactttcagataatccggcaagcgataaatcataatagaagcgtcttgtgtaaagtcaacccctttggcggtattctcattattcgtatttccttctttatcctttacgttcagacggacacgcatcaaagagacttcacgtttcaaagcaatcggagatggagttgcagtagcatccgaagaaataactacacccgaaacagctcccataaaaatctcggcaggttccgtataggccgtattgcctgccaaggcagcagaacaaaaagcagggaatgcacccgttttatacttcatcaccatgttctgtacctgtttctgacgtacattccacattccccactctacaggagttgtgcccccatccaaataggtattgatagcatccgctgaacttttcgcatttgctatagcaaccatcgtatatgtaccagcaggcacatctgtataagtaaaagtagtattcccgtctgttggattaactacatctgaaaaccgcacgatattgcttgcgtcatacagcaaaatctgcacctgacggattttactccacgaagtttccggtactgcagtagattgtgcggctctcgttttaccgccctgttccatacttgttccttcaaagttcaacttaactataaagttagccttcgagttccccccgggaacttctcctgaaggcagttcattgtgctccgaacaagcactcatagtcattgcagcaagcaaagaccataaaaacatagatttttttctcataaacaattcactttagtttctacttaattgttgattcagacagaatgttaatttctgatccatttggcctgcccgttacttcgtaggtaacgggactacacaaattccaagataaagaagtgtctttaaaggagttgtttttactaaaatgaatctttacggtcttaaaaacgacaataaagtcctttcccatctttcaacctgaaaaatggaattattttttgttgccctttccgaaaggcaacccgctaaaaatgttcagttatttaatatctattgcaaaaataattgttttattatgcgtaattcaaaaaatatatttaaatttgccgccgatatcatctcccgttacctacgaagtaacggatatttttttcaattagtaatcaagctattagcttctcaaatttttatctgctccctttttcttcttcgataaaatatatgtaataagagagctattcatccgatttacctcatcgtctctgtagggttgaaaataggtttcggttactttaaccgaagaatgccccatagcgtcacaaatcaagcttgaattataattctgtcggagggccgttgtcgcccaggtatggcgtgcggtataagtacttaatcggtctctgattcccaatatgtgtgccacttgtgtcaaccgatagttctgaaggcgtaacattcgggcatattgtccatattcatctttaccaggattctgtataatagggaaaagataaggtgagtccggatttgcatacatatatttctgtataatttccatggcttccttacccaccaccacagtcagtttacgactggtcttgcgccggtgatacgtgatcacatttccttgtaaatcacacctgcgcaagaaagcaagatccacaaacggcatccctcgaaacaggaacaaaagcacaaacagatcacggctgaaagccaattttccaggcaacggttttcggtccgtcatcagtctgcatataacttccggcgaaacagctcttttcaccgggcaatcaataccggtatgtactttattgaaaagacgtggcacgtaagttgccacaccccgctccaatgcttgattatatacagatctcaacatacgcatgtaagtagaaatggtattccacttaagctggtcagccaatagtttctgttcaaacaaagccaaccattccggagtcaactggctaaaggtgatttcacgtccattcataaaatttttcagtcgattcaaagtactctgatatacatgggcagtaccattgcgttgttcttttttcagttcgactattcgcttctccataaatcgagtcaaaagttcttttttcattttaagtctgtttagattacaaattaaattatcgcatgcttttgcttatcatttcatatatcggactgatatttcaacaaatcgcaaaaagcgtagtgccataacaaaccaactgcataattatctcttttttttagataactttgcagccttcgaaaaacttttaaccacaattggaatagaccgagccggctcttctcaaaacaccgcttcaatcatttctcagtatccacagtctcaggcttcacaacctgacttgtcacaagtgtatctttctcagtagtattacaagtaccattaaacctggctttcgattctatttcaagtttacatgtataaacatcaccattcattgtacatcccgatttcattatcaaatcttctgccacctgaatatctccctgcaacatcccgtgtaacacagcaccggtacacgtcacattccctttgatccttccttgaggaccaatcaccactttccctctacaagaaacatttccctctattattccatctaaacgtaaatccccttccaccgtgatcgttcctttcacgattgttcccaatgctattgtagtcagtttatcaacaccgactttcacagtctttacagaataatcttcattcttcttttttccaaacatattaaaatctgaattatgtaaatttaaaaaaggacgaacattcttctgataccaaatattaagtagattacaaatataagttaattataagacaggcggaaaaaaaggcgggaaaatgatcgtatataatcataaaaaaggggaaaaaccgtttatcggtttctcccctctctctcctattattaaattgttgcaaacagaattatttatattcctgccagctctttatctgaatatcttccagtttcagatcgcagaatgcctcgataaacgcacttgccagacgagcattggtgatcaatggaatattgtgatcgatcgctccacgacggatgcgataaccatttgttaactcacgtttcgaatgattcttcggaatattcacaatcaagtcgaacttatggtcggcaatcatcttcatcacattattctcggctcccggtttttcatccggccagtaaaccggagtagtatctaccccatgtgcattcagaaaagcagcagtaccggctgttgcataaatcttatacccttggttgaacaacatgcggcttgcctccaacaaatcgactttcgacttcattgcacctgaagagaacatcactcccttctcaggaattttaaaaccggtagcaatcatcgcattcagcaatgcttcagaaaagtcgtcaccaatgcagcccacctcaccggtagacgacatatctacacctaaaaccggatcggctttgtgcaaacgtgagaaagagaattgagaagctttcactccaatccagtcgatatcaaatgccgacttatcgggacggctgtatggagcgtcgagcataatgcgggtagcagtctcgataaagttacgtttcaacaccttagaaacgaacgggaaactacgtgaagcacgtaagttacattcgataactttaacttcgttgttgcgagccaggaattgaatattgaacggtcccgaaatattaagctctttcgcaatctggcggctgattttcttaatgcggcgcgctgttgcaaaatagattttctgtgccgggaataccagcgtagcatcacccgagtgcactccggcaaactcgatatgttctgagatagcatattctaccacttctccattctgtgccactgcgtcgaattcaatttccttggtattttcaaggaactgagaaacaactaccggatactctttcgatacctcagcagccatcttcaggaagttctccaactcctcgtcatcatagcaaacattcatcgcagctcccgaaagtacataagacggacgaaccagtaccggatagcccactttctctacaaaacctttcacatcttccagactggtcagctcctgccatgccggctggtcgatacccaactgatcaagcattgcagagaacttattacggttttctgcccggtcgatagaaacaggagaagtacccaataccggaacagactgacgatacagtttcatggcaaggttattcggaatctgtccacctacggatacaatcacaccgcgaggttgttccagatcgatcacgtcgagcacacgttcgaacgaaagttcgtcgaagtacagacgatcacacatatcataatcagtagacaccgtttcaggattataattgatcataatcgatttatatcccagtttgcgggcagtctgcacagcatttaccgaacaccagtcgaactcaaccgagctaccaatgcgataagcacccgatcctaacacaactactgacttttcatttttataataattcacatcataaccctgaaccgcataagtcatataaaggtagtttgtcagttccggatgttcggaagcaatggtattgatgcgtttcacggccggaaggatacccagttctttacgacgggcacgtaccatcaggttctctttctccatatttcctgccggattcaacacaaagcgcgcaatctggaagtcagagaagcccagcactttggcctccctcaatacgtctgcaggaatatcctctaccttatcataagcagacaacttcgctttatagtcaacgatatttttcagtttgcccaagaaccacgggtcaatctttgtcagttcatggatacgctctatcgtatagccatcttccatggcctgagccagagcgaaaacacgtaaatccgtcgggtgagaaagctccttatccagatcctcaaaatgcacatcgtcgttaccgacaaacccatgcataccttgaccgatcatgcgaagacctttctggataatctcttcaaacgaacggcctatcgacatgatttcaccaaccgatttcatgcttgaaccgatctcacgagatacaccggcaaatttagtcaagtcccaacgaggaattttacaaatatagtaatcaagttgcggagccacatatgccgagttgggagtgcccatctcacctatctgatcgagtgtgtagcctaatgccaccttagcggccacaaatgccagcggatagccggttgccttcgaggccaaagccgaagaacggctcaaacgtgcattcacctcaatcacacgataatcatccgtatccgaattgaatgcatactgaatgttacattcacctacaatacccagatggcggatacatttagttgaaagttcctgcaacattttcagttccttgtcatccaatgagcaagtcggagctaccacgatcgattcgccggtatggatacccagcgggtcaaagttttccatgcttgctaccgtaaaacagtggtcattcgcatcacggatcacctcaaactcaatttctttccatcctttcaacgactcttccaccagaatctgtttagagaaagcaaatgagctctcagccaatttgaggaattcctcttcattggcacaaataccacttccgagtcctcccagcgcgtaagccgaacgaaccatcaccggataaccaatgcgacgtgcagcagcaatagcatcttccatgctttctacagcctggctgaccggagttttcatatcaatctcgttgagcttcttcacaaacaggtcacggtcttccgtatacatgatagcctcaaccgaagtacccaatactttcacaccatatttatccagaataccttgtgtataaagctctgcaccgcagttcaaggcagtctgtccgccgaatgcgagaagaatgccgtcgggacgttctttcttaataatctcctctacaaaataagtagtcacgggaaggaaatacaccttatcagcaattccctcggaagtctgaatggttgcgatgttcgggttgaccaataccgaattgatgccttcttctttcaaggccttcagtgcctgtgaaccggaataatcaaactctccggcttgtccgattttgagtgcgcctgaacccaaaacaaggacttttttcatttccttttccatttcttttattgtcattataagttgttatttctacgtatccgcacaaaaaaaatgcgttaccctcaataaaggactaacgcattaccaaagaactaaatatcgtttttggagaaaagagaagaagtaggctgattccgggtgaaatacactcgaacggagataatacttgcttctgatttcctgttgattcattgctatttcaaagtttgtgcaaagtaacgacttatttctataattacaaaggaatctggtaagaatattcgttttatttgttacttcagctgattctgactatctttgtccttcgattaaaaataaaaataatgggaaaagaaaaaatcatattgacaggtgaccgtcctaccggaaaactccatatcggacactacgtaggttcactgaaacgaagagtcgaattacagaattccggcttgtttgacaaaactttcatcttcatcgccgatgcgcaggcattgaccgataacatcgataaccccgaaaaagtacgccaaaacgtaattgaagtagccctcgattatctggcttgcggactcgatccggaaaagtcgacaatcttcatccagtcccagattccggaactgtgcgaattgacattctattatatggatctcgtcaccgtatcacgcctgcaacgtaaccctaccgtgaagacggaaatacagatgcgcaacttcgaaaccagcattcctgtaggtttcttcacttatcccatcagccaagctgccgatatcactgccttccgtgccactacagtaccggtaggtgaagatcaggagcccatgatcgagcaggccagagaaattgtccgccgtttcaattatatctacggagaaacattagtcgagccggaaatccttctaccggacaacgcagcctgcctgcgcctgccgggtaccgatggaaaagccaaaatgagtaaatcgttaggcaactgcatttacctttccgaagaagcggacgaggtacagaagaaagtaatgagcatgttcaccgaccccgatcacttacgggtgcaagacccgggcaaaatcgaaggtaataccgtatttacatatttggatgccttctgccgtcccgaacatttcgaacgttatctgcccgactatccgagcctcgatgaactgaaagctcactatcaacgcggcggcttgggagatgtaaaggtgaaacgcttcctcaacgctattatgcaagaagaactggaacctatccgtaatcgccggaaagaatttgagaaagacattcctgccatctacgaaatgttgagaaaaggctgtgaagtggcaagagctgccgctgccgatacgttatccgatgttcgtaaggccatgaagataaactatttcgatgatgccgaactgatcaacgaacaagtaaagcgattcaataaataaaaaaagaaacgccctgttaccagtccggcaacagggcgctttcttttaaagaaggttgagtctgaatttatttagcagactctactaatacaacgcggtttaggtaaataggtttaccgaatttatccacaccacctccggcatcaactttcaagcggctggaatctactccgtatttcttaaccaatgcattgacaacagcctgagcacgtttctggctcaactccttattgaatgcaggagtaccggttgccgagtcagcatatccgtatacggtatattgtgtatccgggaattctttcatcttagcagccagataagacaagttcatctcttcacgcggagacagttcagaagaaccgattgtgaagaatacagtacgcggagcaatattagcatccgttacaactacttgttcggcaacttctgccaccggctggttctgtgcatcaaccaactgctgttgcagtgactggttggcagcagccatttcattcatctggcgacgcatattggccaattctatttcagagataatctgtggcatcggacgggcaaatccacgggccgggaagcggtaagtcagacctgcagtcaggctggcaacgccatcatacccatgttttccaccaatttctccgtcaaacttatcttcagccagcataccaccgatttcgatattgatatctaccgcactcgatacgcggaaacggttgataatacctgcgttcatagcaaatgcctcacgatgaggtttagagtatgaatgagtaaaaccggctcccaaataagggataatttcatatacacggtgagagttgtatccgccaaacagagcattcaaattgaacatcacgtcaccgtgaagattcatatagttgaatttctgtttataatacccattggccagtttaccactcttcacaaaatcggctgtttccgaatgggcaaagccgcgcccctgcaagccactgtactgcaatcgcaatcccaacccgggagtaaaccatttaccgacagccacattcaatgtcggactgatacggtctctgaactttccggcatggtcgttgtcaccaaacatggcttcggcaccgccaccgatagaaaagaaccagttatcccagaaggagttagtgattacttgatatttgtcttgtacctggataacttcgtatcccgtaatcgtagtttgttgcgctgaagcaacagatgtaacgccggctaaagccagcagcattagaatctttttcatataccttaatagttaaagtggttattacaaatcttcctatttattattgaaactatttaaataacaccaacgaaactaaaaggttttggataaatgaaaatttccgaagcattttctacaaagatccggagatacaccttattatatatagctccaaagctactttgacctatttttgttccatgaaaatttttcgtagcggcataatcaatctttccagcagccgaagatcgtccgtgatgatttccgcacttcccttcatctcacgagtcaacggcagcatctttccatagttggttgtcaacccatccggcaaagcaatatcgaccacatacatgccttccgccgtcggcagaggcgaaacacttctcacctccccccttacataaccaaactcctgatccggataattattcagacgcaaatttacacgctgtccggcctttactttacccgatccctgtaaaggcagcaatgccgtccctacaggcaaggattcctctttcggggcaaccacaaaaacggtagcccccgactccacatactgattcacgctccacacattcagaaaagtaacttttcctccgaccggacttcgaagcaggtaatgttgttcccacgccgcaagctgacccaacaactgatccgtagcatttctcagattcacctcctgcgtctgctgctcttcaaacgcctgtttttccagatcaagcaatgcctcttccgattgctctatctgcatatctacctgagtcaactgcatacgggccgattcctttgactgaaggctttgcaagtagcgactgccggactgttcaaactccgtaataatcatcgcctcacgatgataaagaatcgaatctcttgcatatgaggcatgagctaaagcatattctttctctatcagaaaatattgcctccgaacctgatcatagtatttcttctgtgtagccagcaattctttctgtgagtgcaacttctttgcataatatcccaactctttcatacgaaccacctcggagagggtactcacaaatcctgcataagccgactgtatctcacccagccgccagcggtcggtctccgaaagcagaaaaaggtttttccccgattccggtgtatatccttcctgcttccacttctgcatcttccccttcaaagaaaacacatccaccgcacgagccgtattctctattacacccaaattcatatccggcttcacctcctggccgttctgtacatacaggtccgccaatctaccggccgaacgtgccattacataagatggaggctcctgtgtactcaccgtcacctctgcagttatcacatccggatatttaaaccaatagctgcctgccaccaacaccactacgatgataaacaataccgtaatgccactacgcagaatccacgccggaacacggttcatcacctcctgtacctcttcactgcgaagctcgatttctttatgtgtgtgctccttttccatacctaacttcctaactccagctgattcttcaccaactgataatacaatcctttcttctccgtcagttcccggtgagtgccctcttcagccacagcacctttatccagcaccacgatcttatccgcatcacgaaccgtactcaaacgatgtgctaccactacaaccgtcttaccccgatagaatgtatggaggtgttccataatctcacgctcgttattggcatccagtgcattcgtcgcctcatcgaaaaacaggaactccggattcttataaaccgcacgggctatcagcaggcgctgtcgctgtccctgactgatgccgttcccctccattccgatcttcgtattatagcccaaaggaagagaatcgataaaatcacggatattggcaaccgtcacagcatggcgcaaacgttccacatccacctgttcctcaccaacagcaatgttgttcgcaatcgtatcagagaaaataaagccatcctgcatcaccgaaccactcttcgcacgccagagatgcggattcaccacatccagaggagtctcacctattttgatatcccccttattcggagtataaaaaccgagcatcaacttaatcagtgtagtcttaccactaccactcgcccccacgatcgctgtcactttatgttcgggtatatccagattcacatccttcagcacatagtcacggtccgccccgtcatagctaaacgacagattttcaatacgaatatcacgccgatccggaagaaccgtcagttttgaagtgatatcctgttcttcatctttctgaccgtgaatctcgttcaagcgttccagactgatctttgcatcctgaagttgttgggcaaagccgataaaagagccgatggggccactcagctgaccgatgatatacgtcaaagacatcatcatacccagagtcatatccccttccacaaccgatttggcagcaataaaggaaattacgatattcgttgtctgattaaaaaacacagaacccacttgctgaacctgccccaatgccagtcccttcacgctgatcttgaaaagcttcacttgaatgcgttcccactgccagcgcttttgcttctcgcagttgttcagcttgatttcctgcatggcagtcaccaactgaatcaaactgctctgttcgcccgccgcctgggcaaaacgccggatatccagttcgcgccggtacttcatgaacacaagaatccagcagatatagagtgaattgcctaccagaaagatggcaagaatacccagattataataagccagcacaaaagcaaaaataaagaagtttacgaaagagaaaagcgtactgatggacgagcctgtcagaaagctctcgatgcgcccgtggtcaccgatacgctgcataatgtcaccgatcatcttcgtatcgaaataatggagcggtagtttcatcaactttgccaggaagtcagagatcagcgagatgttgatacgtgtgttcatgtgaagcatgatccagctacggataaactcgaccgaaagttgcgaaacggagatcaccagctgtgcgatcaggatcagagtgataaagttcaggttaccgtcacggatacccacatccaccaacgactgtgtcagaaatgggaagataagttgcagcaagctcgctgtcagcattcccagaaccagttgaatcaactgtttacgataaggagacaaatacttaagaaaaaaacgaagactgcgactgccggactcttcctcgtccccctgcccttggaattccgggcccggttcaagcgcaagtgcagctcctttctcctctccgttcaccttggtagacaaccaacactttttaaattcttcctcactgtacgaaatcaactgacgtgccggatcagcgatatagaaacggtagccactgcgcttcttctttatatcataacagaccacaaagtggttctggttccaatgcaggatgcaaggcaacggtacgtcctctttcagttgctccaaagagatacggacccccgaagtacggaaaccgatagattccgccgcatcactgatgcccaacatggaaactccttcacgggtaataaaagaacgtgcacggagggtctgcagggaatagctcttaccatagtacttcgcaatcatgcgaaggcaggaagggccgcaatccatagcgtccaactggaggtaatgaggaaaagaacttagcttcatttattcataatattagtctacgtagcaaaaatacatcacatatccggaatataatgcgcttctcccggaatttgtgaaaaaaattccctgaaaggataatttatctgtttcccgttcagaaaattcagcagcaaaagcatgcccttatactgccttttctttaaaactctttcgcaagcattgctcaaatcaaacaaataggtttcttctctgatccgtacacttttatcccccgaagacaatcgaagcaggacataccacgcaatgccctccagtcccgtagctaaagagtagtcatccaaacgcctgacatcatattccatcactttcttatcaatcttattccgttcttcattgccggcatcttccacaaatccgtaccggacaagatattctatcccccaacctatgccagcccatccgaaagacagaccgaccggcatacccaagcgaacatactccatcacttcatccagcaactcttcggcaaattctccaaaaattcgcgattcggcaacatgagaataacgaaaaaagaaaagacaagatcccatctttccataaaacagccctatgtcagtttgcctgtaggagaaataaagtgattttgctatcttttctatctgtgcatccataacatttcttttttaataactgacaggtatttcatagtcgaggcgataaagttcttttatccgtgctatctgtttctcatctctcagttcaaactgaacggatgtcgcattcgacctctcctcaggtatatcaactcctttctcttctaagaaacagtttaatttactgagtggtacgatacagtccacatcagcagaagtataaaaatcagattgcctgcgtatatgttcatcctgccacaacggatttgtcttccccaattcaaactcaacaaacgaaagaaagcgttcaaaagaatgatcctgataaagattacacatatacatataacggttaaaagtacgttcaagtataaaatatttacaagcagaaaccagtctttccaccggatccctccaaaccgctaccttcaaatacgatttatgctccctttcataaccggacatctcagaaaccggtaccaaaaaacgttcgggttttacccgggcgatataaaaatgagtctgatcttccgtatcaggaatcatacctatagacgcatagatagctatattctccaaaaaagtgagtccacatttcgaaataaggacaaaagccatacgatgcttctctacaagacaaaagttgcatccgaagaagtctaatggtggtttgtttagcattgcaatatctttcatgatatactacgattttcgatgtccaacatacatacaataaagtgattcagttccctgccatagccccttatccttccatcgtctggagccggtcatagtacagtttcatcctgttcagtatctcctcactataccatcttccaagagactcttgccgactgagttcctcacaaacacgaagcatttctcccgccctatcgtacaaagtagtataagttccgtccggatgcaatgtacaggcggtagaatatatctgcaacagcctcacataaagcgcttcttttgcctctctatgttttttctcaaacaaatgtttacggctatattccagtaacttctcaataatcaattgaatggaagcaatccgcctacccgctgctgtcgctgtcataatcgatccttcccgttgccggtaataataaaaatcaatatcggcaaccgtcattttctgagcggttgtcagcacctgcggagtccataattcatcctcatgaatcagccccggctcaaagcgaaaaccgttttgctcaataaaatctctccgatataaatagttgtacaccatagggacataacatctgcaatccatcactcttgagaaatacgtacttccagacaccacggttcccgtcgcaaacaactccctgctccttctttcccaacttcgcacctgcccatccggatgtaccgccaatgtatttcctgagacaatgtctgaccgggtcttcgcagctatagtacaaagcacctgcaaagcattctctgccagccagtcgtcactgtccagaaatgccagataatgcccggatgcatgttctattccggtattccgtgcagcagaaagtccttgattcgcctgttccacataaacgcaacgagcatccttacccgcatactcccgcagcaactctccggaattatccgtcgatccgtcgttcaccagaatgatctcaatatccgtcaaagtctgcttctccaaagagtgcagacattcctccagaaaaagttccgtattatagaccggaaccaccaccgaaactaccggtctttttacctccttcatatccctctcaattttagttcgtgtatttttggggaatcaatatatccatccaccatctatcttttatcaagctgcgaaacacatttatctgccactactcgtcctccccctttcaacatcctccacggaatccttcctttacccgtcataaagaaataagcgaataccggttccgcccaacgtacggcaacaaaaggtttatatctctgttgtaaactcctgtacgacagcttcacaaaggtgcccaaaggtataaaccgctccggatgtttccggtaagactgccgatagccctcttcatgctccttcatcagggcacgcaaatgaaaccaacaaaagccgacatccaatatttcattcggacagcacatcacttccagcccccgatgacggccatccggcttcgtttccgtcacatacctgaatatccggtccgcagacacctcaaaaaagaaagtatcacgcacgccattaaacggagggagtatctctttgctatcaggctccggatgttcctgccccaaccctaccatccactcccggtctttccggaacaagttaatgcccgacatcgagacaggcactttataccggatgatcatcttctccagataagaagcatacaacgcatgcgtccacaacgcaattcgttccagccacctgaacggtcgcatctctatacggttgaaagagtccagataagcccgatacaggttgtaagagatacattccgccacgttgaaccgcacttttttatcagaacggtaagcatcacagatatgtttcagccgatccgtaaaataaacctgatcggcatcgatcttcactgcgtaccgatagcttgctttcgacaatgcatagttgcaatagcctgccagcgtatggatagagtccggtggtaacagttttgccttctccaactcctcctcatccagatcgatcggatatacagacggctgatactcaaagaccctgattttatccggatattgtgccgccttctgcctgagaatctccggcgtacgatccgtacaatcatgatagacagctatcaactcatccaatccatcgatacacgaatcaatgcacatctccaaaaaatcctcacaattcttacagcgcaataaccccgataccccgacgggccgttcgcgtgtcaacgtatccgtatcaaccacataaatctccttcaacgtaacaggaggcattttttctttaataaaccctaccatattccggagagtttcttctcctgttgcctgaaaccacagaggttgttccttctctatcctctgtttaaaatcttcataattccccaatatccgggacaaaccgccggtcaactcctctttcgttttcgctatcatccccagttcctcggcttccacatccggagaataccgcgatccctcggtcggatcgtacaccaacgggacagcaccgtgcgccactccctccattaaagaagaagaatagtgtgccacccctacccgtgtgcgggcaaatacctctgccagcttttcatccgttaccatttctatattgggaatctgctcccattccatgcgtacctcctcacctatcctgaactcaggatgttcacgcaccagaaaccgccggacggggaattccgcggctaccgtccctatcagacggatcatctcttgaagataccttttgtcactcagaaaaaaaggtccctgcaagaaaaaagtaacacactcctttttcgtctcattacgcggttccacctgatacatatagcccgtcggaacaaagtccggaaacggattatgcttctcccacaaagtccggaaaccttccccccacatcagatagtaccggtaaggcatcctcctgaaagctgtgtgcatcaatgacggccatccctgctggatacacaaggtcggtattccataatcacgccctatggtggcaagcaataactgctggtaatggcagccttccagaaaaatcaatcctttaggttgcaagatcctcatcaatatatcaaatgtattcgcatattgaaaaatcaaagggaaccactctttcaggaatggattaaccaatggagctgttttggtaaattcaagagtaatggccgttacaaagtccggcaactccgtttcatccggaatctcatattccgacaagagcaacaccggttcttccagacgttcaatcaacggagtcagataagccaattgacgggcattataaatatagatcaccaactgcccgccataaggtgccagtgcttcataccattcatggtcgtagattttgtattccttttcctgtcgcccccattcttccacctgcttatcggccagtatctcctttacgctacccaatgcttccccacagttctttccttctttacgtaaccggtcgtactcctctctatgccatgtgaactgccagaatagtaaattgatcaaaggcacgcccacatcatgcctccccattttcagccaatactctttctcttccctcaaatggttcacgtagtcagacagcaccctatccagtacttcataatactccacataatagtcccgtctatccatatctttttttattaaagcccggtttcaatataatgttcagccaatctccagtccgcttcttcatcaatatctatcacccctgcaggaccgacctccaccaccttcacaactcccgaaagaagctgcccggagtccagtattctccccaccgtagaagcatagaaagctcccgactctatcagaaaacctttgtactcctgccggcgaggtttggtttcgaatgaatagtccaaaggtctcccctcatcactccaacgaaacttcttcaaacggcaacaggcaacataggaatccgcctcaccccttttcatctcttctgcaagcccccttagttcttgtgcagtcgtaaaaggagaagtagcctgtaacaaaataaaatcatcattccggtccggcttgcgaaaatggaaaaattcctgtacaacttccagactgggagcctcatcccttgcactccactcactgcgcctgaatatctgtacaactcctttgtaacggcctcgtataagactttccatttcatcacaattggtcgctacacatacctcgtccgctatgccggaagcaaggatggtatcgataatccaacataccagaggtttgtctcccagcatacgtaggttcttaccggggatacctctactccctttgcgaaccggaacaaaacagaaagtacgattcataagctattattgtttacggtttcacatgacagaggttcggttttccaatagccaattcataattagagggcgaaggacacagccattggtaaatgcagtcacagcaaggtttttgatcgcggatgcgaagccaagaatgaccttcggtcatctctttatatatcagtttccgaacatcattcgtccagatattccccactgtaggcgagagttcatttgtatacatatctccattcgagcataccgacagctttccaaaatcattagaattgagtatctggtttctcattaaatcctgcatagataaatgcttggaaagaatgtcctcttcatacaggaaaacattctcttcaaaaaaaggcaaattatcgcctctatactcgggttctatcttatattcctgaatagcatacttttctacaatttcattggcctgttccagctctttctccgaaccgacattgaaaatccaatacacatgaccttcctgtcttttcgtaagttcccctatcgtttctttccatttttcaggctcaattacctgtatggtagtcatataccctgaatcgactgccaaagataacgccgagttatctgtacctaaacaacccatccactccatgacatcctgcaccctttccttttcaaggctccacgcttgcaaggcctgctgttgttcagtcgtataaaccacaaacagaagtcgttttacttcactacacacaacttcactccatactttatcagccagcctgcgggattcatgttcatccaaatgatcaaaatcaaccttaacctgatataaatacgtgaacatgttcgtacctacgaaccccgagtcaaagcgctgcaagcgagtcacttcttcctgcaagttcagtaccggatacaattgtatcggttttctgtcggacaactcgcaatcataaaggtcaccgaaaaatttatctctcactgttttaagaaaatcgaatgtaaccggacgctccaaatcctccttcgttatcttgataaccccgcaattctgtttatcaacgattgccgtcagtaaatcaagcaattcaccgtcagtcaccctgatatactcacgatcgagtgtgttatatagcaatgcttcgtcttgttttaacgcaatgtgaatataaggttcaaatgcaaaccaatattcctttgtagaatgtatcataattgttattcttaagccaatactacttccattattctttcatacgctttgggatgctcttccagaaacgaaagattacggctcacgtaagccgcaaaagcttccttaccctcaaagctcggacaacgtaccttttccaacgcatacagacggtcaatcgtaaatatacaccgtgtgcacgattgcgaacggtaacaaacgcgacactgcgcacgcaacttatcataatattgattgtacagtctcgctatttcctcacacgacaaacggatggaatgatcagcctctatagtccctaagccatattgctgaccgatacgctcacacgccaatattttaccattgacagtcacaaacatcttacgggcaaaaggcatacagccacctgtcggaataaaattatgggagatctgtttaccgaataaatcattgtaggactgatacacatttccattgtattgatggataaatatacaagcttcgctgtaagccggtacgtccataaacatctcatccaccaacacctcataatcttcactttgctccagatccgccactttattccggtacatcttttcaaactcttccttcttatcctcccgaatacctgtcgtattcagtggagctacatgcggcttcttaccatagcgatcctttataaaatgaaagatttcatccaccgtatttctgttgtgcagcacggcattgaagttcacgtaagtatcgaaatactcaggatatttctctctcagcaagtctacatgcgcaacgttcttccggaaagaattctcgcctcccggtgtcacccggtagctgttgttccattcatttccatccaagctgatcaataggttaaacttcttctctgccaggtaatccatacatcgatccagcagcatcgcattggtagtcattgaatattgaatctttctattttttatatccaaagattcaatataatcaaccacctggcgtatgaacgtcatattcatcaaaggctcacccccataaaaactaataaacaacactttattggtaaaccgctgcctggattccgcccatatctcctgaagaaaatcaatgatgcgtttggcagactcaaagcccatcattttcttacgccgttcgtcaaagtcactatacaactctccataaccgcaatacttacagcgcaagttgcaggcatccgtcacctcaaaaaccaattgcttcagattcgccaactcttctttgaccatatccgcagtgatcacaccatcgtatcggtgtccaagcccatctaaatagccatgctcctttaaataagccgctttccgcgcatagtaatcagcggtatccacttgctctgcgtactttggccgcaaatgtggaaccagtgatggatgtgttaagaacagatgcttcttttccctattaatcgtataaatattgcgcccggaggtcacacaacttaatgtatcttccatcattttatcgtatttagtctttcaatttatagaaagcaataatcggattatcatcctctcccatttcatcaagaagcttcagcagttcggcctgcttctcagggaacttgaccttagcttcagcgacgttgcgccttacctgatccaaattatccagcgttattgcgaagtaaagacagtgttcgcctgcattatggaagtctttgaatgattgagagccatcaacatcattcgttatccctggtgcatcaagtatgtaccaatggacagctttaaaaggagtctgctcccaagaatcaatcttttccgtttttttatcatatcggctaaaccacatctttttattaaaccaaaatttaaaaaaaagacattctttagtttcacaaacatctttcatcaaaataaaatctccccaacccaaatcacgagtagggttatatcttccggaaggcaatttatattttccaagagaaagatggtaacgggaaaagatagagtcgcaagtaatgccgtagatcgtatcattaacaaacgaataaacgttacttcttccacgataaaaccaagaggggtcaggatccaaatttaaactttctctaacgtcagtggtcaagtaagggatctgctccatcaatgtctccccctctccattcgcaacacaagcgcttatgaatgtctttccaatatcaggcaaataaacagtaccaggataataaaccaaacaatctcccatcacatcaatggtccaacgtaaaaaaataggcctcttcaaaggaaactccttgacaaaactattatcccgcatatcatagactgttaggctaccattacggctgaacggataaataaataccaaactatcactgactgtgaaacagtgaatattagctatctctccaggcccctgaccgacatgaccgattttacggataaactttcccgtagtatcaaacatcatgacatggttctgatgctttgaataaataaagacaaactcctccgtccgctttaactgatttatatcaccgactaatatagtatccagtgtttccagcttcacatactccacatcttttatgatgtcactcagcagtaaaggcttgccgcaatctttcagattgttagcaagatcaatgtctttaaaggtttcctcagccggtagagcgtcatcttctatagaaacaggagatgaaggtttactcgtgcacgcatttaaaaaaaacagtgcacagaataacaaaacgacatttctattcatacacattattctaaataaagattaatgaagaagatgtcaccaaagttgctttcagtatggatgatacaatcttcagcaacaccctcttcggtcattcactattaccacaattcagcagcaagagtactagtcgctccctctttatctcctggcttgaaacaagccttactaccaccaggtgaatgtccgccattatcacccactgcaacattagctacaccgttatacaatgtagtagaacctcccttgtcttcatgattgcaaccgcaaccacaaacacgttcaccaccccgaagattattcatctcccggtttttaagctcatcatcattcagatgattcagcttgatttttgataactttttcataaaatcttctgtttttaattataaactccctaaagagctaaaactatttttagatatgtatcaagaaggataaagagaaaaaaatccggatggaatgttctcaaagatgtgcacttcttttaagatcactcttttttcaatttatctaagaccaatagaaagaaaaaccttttaaaggtatcctctctataaatatattatagctataaatatattcataaattttcataacatttttttatccgatccatcatattggcatacatgtatttttcatgaaacctatccctgtatattttgcctattagctgccttttgacttggtcattcagcaattccaatatcttgttggacaaagcttccgtatctatcacatactcctctccccgatcttttataaacccaacacgacactccggcaataacatctccgaaagccccgttgaatctgtcccgacaatcggtagtccgtgcatcatcatttcaatggcaacgtagctgcattgttccaaaaatgaaggcatcacccctatatccgcaatccgataaaaatcatacaatgtctctttgccgacttttcccgtataggttattcgtgaccagatatcagcgcttgctttcaagcaagtatcataatctccatccccggctattaacaaatgtgcttcaggcattctattcagaatacgacgaaaagcttcaatcaaaaacccaactccttttccttcatctaaacgtcccacgaaaagcagaatcttttgtgaccgggtaaagccatagaacagccttttgtcaagccactcccgctcattcagtggtctatattcatcgcagatgctgttgtagaccagtatcaacttatccgcaggcaacctataatcctcaaccagcacctctctgatataccgggaaaggcagaacacagcatccattttttcaaagaacttttgctcgaacttaaaaatagtatatacattcttctcaaacgacgaaccttcccctttcctgtttagaatagaatgaaatcgttccgtattccctttcaacccaaaacaccagtccaaataatggatggtggtcaccatcttgcacgaaggcaataatcttcttatttcatcaaccagatacatattattctgatgattaaagtgaaagatattgcattcacgggcatccgtatacaacgtcagcatataggctatgttccggcttaaccgtttctcctcctgaaagcgtcctgtgccggcaaccggaaacttcaagattctcaccctcccggattctgcctgttcgactgtaaattcattcaccttggtttccagccacacccatgtcaaacgcagtccctcgcaatcactgaaatatctcactatctcccgaatataggtaccaatcccgtattgcgaggaacgattctctcctttatttattaaatagatatgtctcatttcagcctccgtacgtccattgcccttgttaatatccgcaaaccgtgtttccacgataactcatcttctgcaaaatcggtttgcagaacctttttccaaatcgatttccacgattgtacttcgggacagactttacgcaaagcctgcaaataggcaccatcaaaagatgacagttcattggctgagtggcacaaccgcatatccacataagcagctatcccttgcgctccggtctcccacgaaacatctttcattcttaaaagatcacgctccatcactttgttatcaatctcttgcagtgcctcgtctgccgacagctcaacaaattgatgttgcgccagatactctatgccccaacctataccggatagaccattagaaaaacggataggtacttcgtcatggagatcttcaagcacttcatccagcatttctccggcaaagtcttcatacagcgcattccctgtatggcgggcataatggaaaaaaaagattacgactcccattttgccgttcaatattcccggatctccacagaaactgccatgcagcatctgatgattggctattcttctcaataatatttcatccgtttcgttcattctctttccaagattttatatattcactcaattcactccgctccatgctacatactttcacaaactccatccggttcttaaaagccagttcctcggttgcatatcccgagttttcacctcttggatgccatagatgatacaaaggtccatcctttacccaatgtacaggataccccaatatctccatacgccggatacgttcagcgtcttcgggtccccagctgatgaaacgctcattatcacctccactacgtaaataagtttcacggttcaccacaaataccccaccgcatgaaggacgtttcatcagatgggtatatccttgcattgccaaatactcacatccctgccccgactgctcaaatgctttactttgcttatccgacagcattttcacaactccattatatggaatgctcaaagcatagtcctgttccataatagcttgcgccgagacttccaattgagacaaagggaatattatatcagcgtcccaaattgctacaacgggagtggtggcctgttttagcaaagagttgacataaaccgttttatgatagaccgcactttcatcatacacatacgaataagtcaccccgttatcctctcttaccgggaagtagccccttacccgttggcggaattaacttagtgcgtatttaattctgccaataggcttgttataactcaattctatcactatatctttccgcatttcacttttttgtagtaactttgctgcctatttcttccaaaattctttttaatttgttgatggcacttgtcatattattggttggatcagcattttgaggccagaattctttctttaaatcacttttatttattctgtaatttggactgtttaagaaaaaagttaatattttttgttgctgattaggcattttgatcggatggttgttgaataagacaaaatctttttcaaaaacaaattgatcctttaatgataactcttcttttatggtagaattagtttgcttttctgtttctacactactgccgactggtatggtttcgatgatatgaggtgcaggctctgctgtatcggctgctggtactgatgtcttttttcgatacttcctatgataccgtataaacagaatgatgatgtagatgagaatcagttccactattaaattgatgtagatattggttttaggcattcgcttccacaaagttgagaaactatagtcgatatacatgatgtaatctatgctaataatttcatcctccaaatggcagataatcttttctgcattatgaggaatgttactttgaggttgactccacatttctttttgcaaatgtttggagacaatgataccagtattgatatatccttttatttcgttcttatttaaactattaattattagatcttgtatatcacagctttgtaaactatccatcataagtaaccctaattggcgggcgaataatatttcggtatcgataccttgaattttatgctgataggtaaataatgtatcttttgagcagaaagtgcgagtttcatatgttcctattttcttaggtgaattactaagtccattcagtgctaaatctttagctttttgggcaatgttattaataactgcttccttcagaatattttcaatttgtggcttgaatgcttctttttctttttgaataagggagtggataattgtataggttgaagcgcctatagcaatcataataaatagtataatgattccgattactaaaaatattcttttattcatatttgccagatcttgtgttaatgttgcaaagttactttaaaagttttaatttactgcttatttgttgaattaatgataaaatcaattgctatcttattagagtttaatatgttgatatttagacgtcattaaataaaatgacgttattaataaaagtgttgacgtaggatatttgtgcagttctgtttactcacttatctttgccgatatttattaaatttattgatgaaatgaaaataaagattttggcagtattggccgttattacagtagttatagtctctatgtttataagagaaaagagagaagatccttcatcattagtaatgatgaacatagaggcactggctacaggtgaagggacttcacccgctatatgtgttgggactggttcagtggtttgtcccaatgacggatccaaagtattatattatcggtaataagaattatgaaacactatctgacatttctcgttcttttggtaatatttaccgggtgcacttcggatttgccaaaagatcgagtgctgtatgcttctttccctaaggaagagacactacactccaaggtcattcagcttgattctgtttatatgcgttatccgtttcggattcatgtatccggtgatcaggcggtcgtcttggatttacatggtagtgatgtgtattgtcatctttttcattaccctgatttccactatctgtcttcgtttggcaggcggggagactcaccggaagagatgctttcagtagaaacagtgaaatgtatagatggttcgtattggactttagatgccaacaaaggcgagttaactaggtttgagtttgtttcggatagagattcgcttctgcgtgcagaagcggtctctttcgataaagacagcattctgcgtgctctcgattttgttgcattcaatgatactacttttctaattcccgactattcgggagatagtcgtttttgctgggtgaaccggcagggaaagttcttgaagaaaagtggaacaattccttcttccaatgaagaagccttgaaggaagctcgtccggctttggcacaagcttggcgtagttttatcgactacaatcctcacaatggtgtgttgattgccgctactcaattaggagaggttcttgaaatttataatcttcaaaatggttctcataaagtctgtcaaggtccaaaaggggagccggaatttaagttggcaggtggttatgcaattcctgacgggatcatgggattctcggatgtacaggttacagatgatgctatttacgctatttttcatggacgcacatttaaagagatcatggcgcaacaccagaaggaaggaagagctacagacggtggacagtatatttatgtatttaatcttgagggtgaacctttgtgtaaatacaccttagatcgttatatcacaggtttccatgtagatgaaaaaaataagactattacagcgacagatgttaataatgaccagcccattgtggagttccgctttagttaaggtcaagtgtaacaggttcgaaaaggagcgggtaaagccgacttgtcgatagggaagctatttccccgctcctgacaacctttagaaaaggaggtttaacaggcacaaatataataaaaaactgatggaaaacataaatgaagcatttagattttctgctggagggagttagctcttccgagaaaggagacagaaaatgtttagtctttaatttatattaatttggaaaaatgcaaaaaaaaatatttgcgatactgatagtcgctgttgttgcactgtttacaggttacaatatttatcagggccagagtgcggaagccactttgtcggatttggctttaactaatgttgaagcattggctaaaggaggtgatgaacctggtactcataatcatggtccaacaagaaatcctttcttaggaaaaaatattgtaaaaatgagaatcaggtagattgtgcttattaaatgtatagcatatcataaatactgataaagagatttatgatatgcttttactactttttatatagatgtatgaaggatagaatcttttatttatttttgattataactttagtattaacagcttgtgatcaaaaacttaaaaataagtcaacgttaattagtaacattcgtgttgatttcagtgaagcttcttttgaaaatttcaagagattaaatgtggtagatacaactttgttaatagcattagcagaagatattgaaaacgatcttgttttaggacagttagataaaataatcattttaaatgatactatttatattgctgatacttatctgaagcgattgcttatgtatgatatgcagggaaatatattaggaaaaataggaaatttaggtgggggccccggagagtttgcttctttatcggatttttgtgtaaaaaaagatgggaggatttacatttatgatagtgcgagtaacaaaatacttgtatatggtaaagaatcaaattttttgagagattatccgttatcatttaaggcagaacaatttcaggcaactaaagatggatttctatttggattggctccatataatcaggatgatatgacattaggcaagcaaatagcgtatactgataatgagtttactcttcttgccacggcattggaatatgataaaaatatagatagcaattatgaatttctctctccaatgattcctgttggtgatgatgtaatttacaatcgtgtcataaataataatatatatatattgggaagcaaaggtgaaaataagcagattcttcactttgattttggcgattataatattgttgcggaggatttgaaagatatcaatgctctactggattcggataaagattattgctacatagcttacccaccggttatgattgatagtatgataatgggggttcttaataagaaaggggaattgtatactttcatttatgatcagaaacgagatgaaatggctttaaataggttagctgatttttcttgtaagaatattaatcttccgattacttctataggatctaattttttggtatcttattttaataaagatatatattcgagctattctcaatcagatgaattgaactttgagttaaaaaacaagatagatcaaggggcatttgtcttatgtttgaataaaataagaggtgagatataagaagttttttatctatttattatagttatgtacaagattgctttttatattatttctgttttaacagtgtttacttcctgtacatccacagatgtacctgataagatgagtttacaacctcaggtaatgaatgatagtcttttgacgactatgcctggtgacttattgctaatagatgattatttagtatggtctgatcctttctctgataacaagtttctgcatgtgcatcgttcttccgatggaaaatatatcggttctatggggcagaagggagaggggccgcaggaatttgtaagtcctttgatcaatcgcttttccattaatcgctgtattgccgctcatgatgctaacgggaaaaccagaggctatttatctattgacagtttaattgccggaaaagaaccttttatgtctttatcagattttgatcggaatatacgaatggctaaactggataaacaactgtatctgattgaaacagaaaatggcgagaacgattatttcaaggtgagttcaaatgggaaagaatctacatttggagtctatccggttcgtgaagtgaaacagcatatgggtacttataaaacatacgataaagatcgtggactgtttgcttttggtccttttaatttttcttatttggccttatataaaaaggaaggagacaattttaagttattatgggaacgtatgcctgaaaaagaaaactattctgttgttgatggggcaattaggtttgatcgtagtgtgatgggagtgagagacatatgtatgactaaagagtatattgttactctggagcgcgaccgggaagttgatccgttggatgaaaggactgttggacgtaatgcaagtaaatgtccccgtacggtttttgtatatgattataatggcaaattactgaaaatagtagatttgggcatgcctgtaatgcgtattgctgccgacggacgaagcaatgccctgtatgcgataggagttaatcctgattttgtgttggcgaaatatgatttatagaaattggcttgggggtattgggataacttgtgtacttttttcctcatgtaaacccgcggaggttgatgtacctgttacttattgttcgtctttccttttgaaagatactactgttatgctttctgaagtagagatggatcctatacaggtaaatgcacggtgtatggtgtgggatggtgataagcgggtattggttcgtacgtcgacttcagattctatttatgccgtgtttgcttatccggaaatgagatttttaaattacacaggtaatcagtcggagtttgtaacaccattagtgggatatgataaggcattttctttagtaaatggagattctttatatgtatataaattgacgaatgataatcagttggaaaaaaagtctgttcattttttatgtaattggaattatagaagagtgttaggactgaaaagaatgaatgatatattgtatgtttattctggttcttctggtgatgccggactaaatgaattttttgtactgaatgcagaaacacatactttatcttcaaagggacgttatccggaaagttctaccggtagatttaaatcaatatcagattttaagtttgcttatgcgcacggtgtatggccaaaaccggatggagaccgcatattggtttcttatataaggactcggcgatttcgtatttatgatatggattttagattattgcacgatgtatgtcttgattatgcatctaataaatatgttgtggatgcagaccctaatcgttggacgacgtttattgaagactgttttgttaccgataaatacatttatttgctatgtccggaaggtgagaaatccagtttggttatagtagattgggaaggcaggccaatagcgcgttatcgtttggatgaaaagatattttttcttttttatcgattccggccgaaatcttttttgtggtattaattcgaatcatgagcggtccttttattttctcgatttggatataaattagtagatatttatgaaatatttgtatgtattgttagctttttcctttttgttttcttgtaaagatgagaacaagaaacaagcggagtctattttgaaagaatggatgaataaggaaattgtttttccaaagaaaatgtattttagtattcaaggtaaagagaatgttgattttcgtataaaagacaccgaatataagattgtcgcctatgttgattctgccggttgtaccagttgtaagttacatttatctaaatggaaagagttaattcactatatggattctgtgcagcctgagcatgtgcagtttttgtttttcttttttcctaagaatggtagagatatatatcatactatgcggatggataaatttacttatccggtttgcattgatactcttgatcatttcaaccaattaaatcattttccttcagatgtaagatttcagacctttttacttaatcaagataataaggttgtggcaatgggtaatcctgtgcaaaatcctcaaataaaagatttgtatttaaagattatttccggtggtaaagctgatttaaaagaaaatcgcactcagaccgatgtcgagcttgaagacacattagtggatttgggaattttcgattctaagaaagaacaaaaatgtatttttactatacagaataccggtaagaatctattagtgattgatgatatcaacacttcgtgcggatgtactaccgtagagtattcaaaagaaccggttcaatcaggaaaatcgatagatatagcggtaacttataaagctgagcatccggagcattttaataaaacaatcacggtttattgtaattcggaatcttcgcctttgcaactgaagataaaaggagacgctaaataaaggtaaaaatattgccggctgacgattgggttgtggtggacaaataaccaaggggggcgattttgttcaatggtttatttctaggagtagttggtaaacttgctgcaattcattgtaagccggctttttatgaaacatagtatgattggggtatcaggaaagaagaaaattatgataaagatctatttgctttgcggattattgggtgctgttgtctgctgttcttgtacggagaacaagcggctgaagtatgctctggagtttgccggagagaataggggagaacttgagaaagttttggaacactataaggatagcgggctgaaacaggatgccgcacgattcctgattgaaaatatgcctcgttattttagttatgaagggtggcagttggatactttaaaagcaattcatgcggctacagtacatacggatggttgggtaaataaggaagctcgtaaaaagtgggagcatttctcttatcggactttaaaaagggtatatgatgctaaggtaattagagctgagttcctgattcatcacattgatcaagcatttgaggtttgggaaaaacgaccttggaataaatatttgccgtttgatgatttttgcgagttgattttaccgtatcgggtcggggatgaacctttagaggagtggcgtagttggtataaagagcgttatgaatctatattggattcactctaccaagggacagatgttgtggaagctactgattgtttgggagcttatttgcgtcaggaaaaagatttcaggtatagtgtcgagctggaactaccgcatctgggtgcaggatttttgctggccaatagggttggaagttgtgaggcttcttgtgattttacggtttatgtcttacgtgctctgggtattcccgccgctacagacatttatcattatggtcccgggaaaggggccggacatgtctggaatgtattgagggatacaacagggggatatgtacctttctggtttattcagactaaagtggaacggggaggaaatgataaacgtgaaaaagggaaggtgtacaggcaatgctttggagcgcagcaggaaaagatatcgggtatccggcgtgatcagtcggttccgttcccactgaaagatccgtatctgaaagatgtgactgatgattattttccggcaaaccaggttgaaatcgaaattgattctcaggttaacaagaaatacatttgtttaggcgtgtttacgttggaagggtgtatgccaatagatattacattgcagaaaggaaacaaagctacatttacaaatgtggaaccgggcattttgtttcaaccactttattttaatggccttaagtgggtagcggccggatacccttttcttgtggatgaaaagggagaggtgaagtatcataagcctgatttttccaaaaaagaaagtatggatctgaatcgtaaattcttgttacggcaatatctgaaagattatctcagtgctgtggtgggaagtaagatagaaggggctaatcatttggacttctcggatgcttgcctgctgtatcagatagtagatactcctaaagtaagctatcaggcagcttatccgccatcggaaaagaagtatcggtatattcgttacacatcacctcccgataagccacttcaactggctgaactacagttgttccgaaattcagatgatcaagagaagctttctgcgaaagttgttggtggcagtaatacttttattgcggatgaccggttcgatagtttaaaagtgaatgatggcgatgggctaactttttttctcaccaaagaaaaaggagcttttgtgacacttgatttagggaaagcggaaaagatcggaaagattgtctatatgcctcgtaacgatgataactttattcggttaggagatcagtatgagttgtattatcaggatggatttaatggttggatctcgttgggtaagcaagtggctacagaattaacattgcattatgataatattccccaaaatgcagtgctttggctccgaaatttatcaagaggaagagaggaaactgtatttcggaacgaagagggccggcaggttttctttgtgaagtggtagaaagatgaaaatatcagaccataaaaagaaagctatgttgattttctttgtcggatatgatacaaatgctcaaatgacctgaatttactgctttttgacctgtaattgtcccttaaagcccttttttttctcaaactttgtggtgtaaagctgacataaaagtttgatgatcatgaaaaaaagattgagagttcgtggaattttatgggggattttattgataactgtatcaagttgtatagaatctgataggattatgcattatgctcaatttgagcataccataaatttgaaatccgatagaatacaggttccttcggtgttattgtatccacggagtttagttttatgtgatagtaatctgatagtattcaatgaaaaaatggatactatgtttcaatgcttccatttgccggatttgacttttcaatatagttttggaacacagggccagggaccgaatgatttcgttctcccttctattacccctgtgaaatatcaaaagaatggatttgtcatgttagacggaattaacctgaaacatattagtgttgagaaagataaagctaccgtacagacttcgactttaaattatggatttaattgttttaatgacttgataagtatttccgatagcagctactgttgtaatggcggctttgagaatgaaaaagaatttaggtttctttatcctgacggaaatcatgaatcatggggagaatatcccgaaacagaggaacgtttcggatctgttttgggcaggaatcaagcgtatataaagatgaccgtcgccaagcctgataagagttgtttcgtttcgttctaccaacatatacgccgtttcagaatttatggccagaatggaaaactaaaaagagatgtaattttagatcttttcccgggacaggaatgtccggaggtagatgataatatgaggcttatacatcctatatgtgtgtacacgacggataattacatttatacgctaaatctggatatgacaacagaagatgtagaggataggaaaacaacccctaatattcaagtctttgattgggaagggaaaccactcatacaatataaactcgactgttttattaacacttttgctgttgatgaagttgcacataagatttatggcgtttttgtggaggacgaagatcatatttatgtattcaatttaccccagttatgaaattgacagctttgcttcttttaagttttttattttgtgctcaggttgttgcgcaagtttctcaaccccacggagatcttttgcgtggtgagacgtatgtgattgaagtgcctaaaggatggaatcgcccttctgctgtgcgttcctgtgatgaacctttgaggcgtacaagagaagggtatgaaacgacaaagtttatgagggtatattctaagcgtaaagatcgttgtggttctgttttgactattatagaagtacaaaactgtaaatgttatcaggaaatatttgagagggacagtgtttcggcattagcagatgctactcgggtaaaggttatatatagatcgattaatggtagaaaaaagatgattgtctcttcttataaagccgatcgccatccggaaactaatgaattatcagcgctacagaaagtcgaatggtatttgcaagggaataaatgcgtgtattatattagtttctcatcctgttctatgtttctggagttacttccacaggtcaaagggattgtagcatcgttaaaggaaatctgagcggaattgaaaatttagtatagtataaatatagcattttattggtattatgataatgattaggagttttgtatttgtagttttattggggatagttgtaggttcttgtcagcaggataagaaaactgtaattcatagaactgatgattatacattagtagcgaaggaagataaatgttttccgttggacagtgaaacggttcaattatcagattatttacaattgatctatatggatggaaaactggttttttcgtttataaataactatgataactcgattgtactgtatgattacgggactgtgaaaaatatgggtaagattaagtttgagcaggagggctcgaatggagttggcagtattacttcatacttgtttttgaataaagattcgatttatttgtatgataggatgacacgttatctgtacctgacgaatgatagtagtcatgtgaaagataagaaacgaatagacattgtcagacgtttgaaaggagattccatttttgcaccttctgaattgtttccgcgtacaaattctcctattttaaaaataggtgatgaattattgttgtccggaactcttttttatgaatttgagggtgagaatgattcaaatcgtcctgtgatggctttctataatttgcagaagaacactcttaggtattctgatagttatccatctatgtatcattcgggaaattggggaggaagttttacatatcgtttcccttattataccttgtctcctaataatgaactggttattagttttgctgccgatcataatataagagtacatcatgtagactcactgcaatatcatgagttttatgccggaaccaaagaagatatcgttattgaaccagttgagaaaagtcttgatttcgaacatttttccccagaagccgatagagatcactatgtccatagtttgaattatggatgcattcactatgactcatatagagaggtctactatcgtttggcaggacatccagatagtagtattgatcctaaagagggggtgctgcgcaaaccaatgtcagtgactattttagataagaactttcaaattgtgggagaaacaatgttaccccaagaactttatttattaaatcaatgttttgtcggtccggatggatttcacattcaagtggagtcagaggatgatgatataatgcgttttaaaacatttgaactattaaaattatgaggaaactggatatagtatggaaatattgtgattatatctaatgtgggctgtggtggatgtatttcggagtcagaggcttttttgaaaaggaatataaatgatagtattgcaggttagcaatcctaaaaaagtagagtgggattttggggatccagggaacagttttgaacaaactatccatattcacaacaaagattattctaaaatgatatcgaaaatattactttattaacgcgcttataataaggatattacgtctttattctgcatcgttatctgagcccgtgtacccgggcttgtgggcctgtgtacccaggcttatgggcccgcatacctgggctcatgggcacaggtatgcgggacgggataaagaaaagaccattttcactaaagatagcaagaaaaacaaaatacaataatagacataaatagataaaaaaccaactatatgtatgtgcatatcagatatttatagcttatttatcccttaaaaacggaggtggaagatggaagatggaggtggaagataaatggcttaaaaacacgatcttccaccatgctattgtattgattattaataaattaaacttaaaaaggtggaagatggaagatcgaaatgcgttttttgtaggaaagtgtcttttcaccacaggattgcacaatacggaaaccttcttaatcttttgtttcaatcattttttaacaggatctaaaacatttggtaatgtttttacgaataagatgtgtttataatttaaaatgtattatttttgcgagtatagaaaaaatatcataatatgtagccttgactaatatatgtggaagaagttgttattgtatgtttgtttaataactattttgtgttcttgtcagaaacaacatagtgcttatgcacctcctacgtttccggaagtaaagaacatacatgctcatcgtttgtcggacgaactgttgatcagctatcctttggatatggctgttagtgagaactatatctttatattggctttggttgataatacatggttgcaagtatatgataagagcacaggccaattgcttggaagttttgtaagaaggggacagggaccgggtgaagtgactactgcaaacatgtgctattatgatgcacgtgaaaagaaaatttcggtgtatgatgaatcttctatgaagttattgacttatcagtttgataaaggggatgataattggggaacattgatagaagaacagcctttttataatttaggagctacagtacgccgggtgtggggacttcgggatgataaatttctggtggatggtcagttgggaacaaagtcggatcagcaaaaacgttttcagatattggccgatactgaagtgtcggctgattataacgattttcctatagatactccggaagaacgttccgtttggttatcacctgcaattgcggtatctccggattgtaaaaaaatggttgtgggaactttatatggaggagtccttgaattatttgatttatcaaaaggcatagaattaaaagcaatccgaaaattttatcctccggttgtgcaatatttatccggaactatccaaagcacaggggagactgtttggggcttctctgcgttatgtgccacggatgaaaagatttatagtgtatttataggtgacaagaatcccaatttattcaataacttatctgtttttgattgggacggccgggaattaatcaaatataatactgattgcctcattctgagaatttgtgcttcgatccgggaacctaataaactttatgggattgctttttctaaaacccgggaattttatttggtctcttttactttcgattcttgacgggagatcgtattaaaatatatatgtagatatgaagaaagaagtttgggtgaaactggtgaaacgaatcggaaactggattgtgaatatctgtttctattcttgtgtggcttttgtagcctggatggtattacaggtattttgcctgacttctttcaagatcccttcaaactcgatggaaccggccttactttcgggagataagatattagtggataaatggaccggaggggcacgactgttcaatatctttgcatcgttacggggtgaggacgttcctatctatcgtctgccgggctttggctcgtttaaaaggaacgatgtgcttgtatttaatttcccttatcaggatgggagtgatagtatcggattcgatataatgaagtattatgtgaagcggtgcattgctcttccgggagatacgttggaaatacgcaggggatattatcatatcaaggggataaaagacagtttggggaatgtgaaggcacaacatcggatttcccgggtcagaagagaggattcgcgagggattgtgatagatgcttttccgtgggacgggcgtttgggatggaccattcaggagttcggtcctcttccggtgccggcaaaggggcaggtagtgaagattgatacgttgtcccgtttactttatggaagattgattcattgggaacagaaaaagagattgcaacaaaaggggaattcagtttgtctgggcgatagtgtgataagagaatataagtttatggagaattattatttcgtatcgggggataatatggaaaactcaaaagattcccgctactggggcatgctgcccgaatcatatattgtgggaagagcatttacgatatggcgttcggatgatcctttgcgtgaaaaaattcgttgggatagggtatttaaaaaaataaaatgacggagatgaaggtagattatatacatattatactccgtgggggacttttagcgatagtgtgcacattgctgtctgtggtatgggtaaatgatccgatgcttccggcaggtgaactgtccggacaatgggcttatctggcaaaggccgctatgggggctgctacaggacttttattgttggcttttgtctattataaaaagaggtatgatatggggagggatttttatcaggtagttgtctggagtcttatagcgttggccgcttccgaggctgtttatggattaagacaactttatggttttacttcttcccatcattctctatactccctgaccgggtctttttttaatccggggccttattccggttatctggccatggtctttccgctttgtctggatcaatggctaaaattgcgaaaaaggataaataaaaactggatcgagtggaccggatattatggggcattggcagtattgtttcttatactttgtgtgcttccggcaggtatgagccgttcggcatggttggctacgattgtttccggtatttgggtatatggtgtacataagtcctggccggtacatctgaagaggatatggatgcgtaaaaaagcaaagatgatagcaattgcttcggctctgtgcatagtcgtgctggtggggggagtttgtctgttttatctgaaaaaagattcagccagtggacgattgttcatgtggaaaatcagtacgcaggctgttatggaaaaaccatttacagggtatggtcaagggagttttgcacttgcatacgggacagctcaggaaacttactttgcaaaaggagattattctctacgtgaagaactggtggcaggaagtccggagtatgcttttaatgaatatttgcagattgcagtcgaacggggaattccggttttgttctgtttcctggcttttgttggtttttgcctgtggcgaggtgtcggcttgaagcgtttaggcgcatgtggtggaataatctcgttattggtgtttgctttttcttcttatccgatgcagttgcccgcctttgttatctctttcgtggttttattgatggcttgtgtcgcagatcgttttcttgcctggcaactggtctttgcctgtgtattggggatttccggatactattggcagcaggcggacgtatataaagagtgtaaagactgggctaattgtcgcatgttatatcaggcaggagcttatcaaagtgccaaagaaggctatgagcgtttatatccgaagttgaagaaaagaggggcctttttatttgagtacgggcattgtttgcataaattaaaggaggcggatgcttcaattttattattaaaagaggcttctacccgaagttgcgatccgatgatactaaatattattggtaagaattttcaggaaaagggggaatatgctgaagccgaaaaatggttattacgttccactcatttattgccgggccggatttatccatattacttgctggcaaaactgtatgctgttcctgagtatttacaacgggataaattacagaaaatggcggaattggtcttgactaaagaacctaaagtgcagtcgactgccgtaagagagatgagagaagaagttaggaagttacttgtaaatgtaagtaacgaaaaaatcgtaaaaagcagaaaggtaaatgattaatatgttttaaatgcaaaaaaaagtctgctttttcttttggcattttaaatattagcaattatatttagggtctcgattgaggtcattccggctttggtttcagtgccggctatatttgttctccggaaataggatatcagataagcaggtttctaccgtgaagaggaatgagcataatagtgagaatagaggatgaaatgtgataggattatctgattttttacggattaaccggggtgaaatgttttttgtccacctctgtttgtaacgtaaaaatcgtaaatggcaaattatcagtattttaatggcagtgtgccagcagaatttagtccgccatttattttgtgtgttagaaaataaccaactatatttgcaaccataaattaatagagaaaagtttaataacattatgaaaaaccaatatcccttctatacgctttgcctggcattggcaatgctgacagcttgttccggtgagaagaaagaaagtgcttctgaaaaaggagtggaaactgtgttgcccgacacgaaaaatgaagtgtccgttatgaccttgaagaagcaggtattcaaccatgaattggtgagtaatggaaaagtatctgccaagggaatggctgatctgagatttgaaagtggtgaggtgatagctcatatttgggtgaagaacggagaccgggtgcagaagggacaaaagttggcagagttggataagttcaaacttgacaatctgttgtcacaggcagaagatgctttgaaaaaatccgagctcgagttgcgtgatgtgcttatcagtcaaggttatccggcagatgatatcagtcaggtacctgaagaaaccatgaaattggcgaaggtgaagagtggttatgaccaaagtaaatcgcaatatgaaatggcaaaatacaatgcagagcatgctacattgatagcaccttttgccggggtagttgctaacttgttttcgaagccttataatctggcgaatacttcggaaatattctgtacggtgatcgatatgcagggaatggaagtagactttaccgtgctggaaagtgagttgcctttaataaagaatggagataaggtggtgattaaaccttattctgatgcggcgacagtacatgaaggaaatatatcggaaatcaatccattggtggacgataaaggaatggtgaaggtgaaagcccgggtgaacggggcaggcagactgtttagcggaatgaatgtgcgtgtcagtgtgcaccgttcgttgggagagcagttggtgattcctaaaagtgcagtggtgcttcggtcgggcaaacaggttgtgtttactttgaaagatggaaagatggctcagtggaactatattcataccgctctggaaaatgctgacagctatagtgttgccgatggactgacagaaggagatactgtaattgtaaccggaaacatcaatctggcacacgaagctccggtcactatcattgaataaggatgaatcactaacacaaaacaattatgattaaattcctgatacaacgtcccattgccgtattgatggcttttacggcttgcttcatagtggggttggtgacgtatttcacgttgccggtatcgttgctgccggatatctctatcccagagattaccgtacaggtagcagcgaagaatacttcggcacgtgaattggaaaacacagtagtgaagcctatccgccagcaattgattcaagtggctgctttgaaagacatgtccagcgaaacacgtgatggtgcaggtattatccggcttaattttgattttggtaccaatacggatttggcgttcatagaggtcaatgaaaaaattgatgcggctatgaattatctgccaaaagatacagaccgtccgaaggtgattaaggcaagtgcaaccgatattccggtgttctatctgaacctgaccctgaagacggacagtgcttatgaagagacagatcaaagggcatttctgaatttatgtgagttttccgaatcggtcatcaagcgccgtatcgaacaattgcccgaagtggcaatggtagacgttaccggattattggaaagacagttgcagattgtgcctgatatggacaaattggctatgctcgaattgtctattgaagatattgaaacggctttggcacaaaacaatgtggagccggggagtatgactgtgcgggatggatactatgaatacaacattaaattttctactttacttcgtacctcggaagatgtggagaacatttatatccggaagggagaccgtatcatacagttgaaagaattctgtcgcatagcggtggtgccggttaaagaaaaaggagtatccgtttcgaacggaaagagagcggtgactcttgccatcattaagcaagctgacgaaaacatggataaaatgaaggaggcactgtcggaaacgatggactatttcaaaaagatctatccggatatcgagtttagtgtgagccgaaatcaaactgaactgctggattatacgatatccaatctccagcagaatctttcacttggtttcttctttatttgtattgttgccgtactgttcctgggcgatatcaaatctccttttattattggactgagtatggtggtatccatcgtcatcagtttcttgtttttctacttgtgtaagatgtctctcaacatcatctccctgtccggattgatccttgcattgggtatgatgatcgacagttcgattattgtaactgaaaatatatcacaataccgggaaaagggctattcgttgaggagagcctgtgtggcaggaacaagcgaggtggtaactcctatgcttagttcttcttttacgacaattgccgtatttgtgcctttggtatttatgagcggtatcgcaggtgctattttttacgatcaggcctttgccgtaacggtaggactgatggtttcatattttacaggtatcatgttgcttcctgttttgtatatgttggtctatcgtaccggaataaaaggagggccgaagtggctgaggctgaagattaacaatccgttgaaagaacataccttggatcgtttctatgataaaggagtcgattgggtatttagccataaaacgctgagtgtactgttctgcgttatttctttcccgctatgtattttctttttcttctttattgataaggagagaatgccggacatcgatgaaaatgaattgatcacccgtatcgaatggaacgagaacatccatgtggacgaaaatcagcgtcgtgtagacgagttgttccgtgagttgcaggggcaatctgtagagcagacggcctccatcgggctgcaggattacatcttaaatcgtgagcaggagttgtcgtcatcagaggcagaactgtattttaagacagaaacttcgaaggagattgctccgttgcagtcagagatttataaaaggctgaaagagcgctatcccttggcggtaatttcgttttctccaccggagactgtttttgaaaaactgtttgtgacaggggaggctgatattgtggccgagttgtatgcccgtaataaagacaaggcacccgaacctggtaccttacgcggactggaacagacgttcaggcaaaaaacgggaatacctccgacgggtattgctttcgaaaatcagttgaaccttagcattaaccaggaaaagttattgttgtatcaaatctcttataatgaactgtaccgggtgctgagaactgctttcaaagagaacagtgtagctatgttgcattcttatcaacaatatctgcctatcagcattgcaggagacgaaaaaacggtcaatcaggttttgcaggaaacgttgattcagacccagccggatagtaagacgggagaggtgaacttcatccccttgcgtgagttgataaaggtaactcccgccgaagatttaaagagcatcacggccggaagaaacggagagtatattccttataaattctatggagtggaggatgctgaacagttaatgactgaggtgaaagaagtgactaatgaaacaggagattgggacatcggcttttccggtagtttcttttccaatcagaagatgctggacgagttggtcgtgattctgttcatttcattgttgctgatgtattttattttggcagcccagttcgagagctttatgcaacccttgctggtattgatggaaataccgattgacgtggcatttgcattggtactgctctggatatgcggacatacattgaatctgatgtcggccatcgggttgattgtgacttgcggtatcgtgatcaatgactctatcctgaagttggatgctattaatgaattgcgtaaagaaggggtacctttgctggaagccattcacgaagccgggcgcagaaggttacgtccgatcattatgacatcattgaccaccatcttcgcaatggtcccgttgctgttctcgtacgaccttgggtccgagcttcagaagccgctttccattgccatgattggcaccatgacgatcggtacactggtgagtttgtttatcatccctttactgtactggtttatttatagaaataaagtaaaacgatagatatgaagaaaagatattatatagtaatggcaaccttgctgcttggagtttctgtagcgaagtctcaggatcatataaaacttgatttgcagaaaacgatacaattggccaatgatagttcactggaagcattccgcacacagaatatgtatctttccggttactgggagtaccggacttacaaggccaaccgtctgccgagccttactttgaatatgactcccgccgaatataaccgggatattaccaagcgatacgattcggaaaatgacttggatgtttatcgtagtcaacagtcgttttatgcttccggtaatctggctatccagcagaatttcgacttgacgggtggtactttctatctgcaatctcaattgggatatatgcgcagttttggcggaagtaagtcgacacagtttaccagtgtgcccatccgactgggatattcacaaagtttggtaggatataattcgttcaagtgggaaagaaaaatagaaccccttaaatacgagaaagtaaagaaggagtttgtatataatgtggaggctgtatccgtgcaggctactacctatttctttaacctggcaatggcgcaggctgaatataatctggccaaagagaatatggtgtcgtcggatacgttatacagcattggagtacagcgtcagaagatagcagccatttcgaaggcggacctgttgacattgaaactggacgtggtaaatgcacgcaatacattgcaaaataaagcgagtgccttgaaacgtgctatgttttctttggtttctttcctgaatttggataagaatacggttattgatatcgatttgcccgtacgtccgcaggaattggtgatacctgtggataaggctttgcagatggcacatgaaaacaatcctcagctactgggattgaagcagaatgtacttgaagccgaacgcaatgtggataaaaccaaaaaagaatcacgttttaatgcgagtgtgaacgccagtatcggtttcaaccaggtagctgataactttggggatgtgtaccataaacccatgcagcaggatttggtgtcggtcagtgtcagcattccattggtggactggggggtaagaaagggtaagtataacatggcccgcaataacctgaatgtggtgaagacttctgcccgtcaggatgaaatcagtctggatgaagaagtgattatgactgtaaacgatttcaatatccagcaaaacctgataaccagtgccgaagaagcacttgatctttccattctggcttataacgaaacccgccagcggtttatcatcgggaaagcggacatcaacagtctgactctgtccctgaaccgtcagcaggaagcacagcagaactatatttccgctttacagaactattggctgaactattataagatacgtaaactgacgttgcatgactttgctaccggaatcccgctgactgaaaagtttgactatgcggggggacaattggtgagatagtgctacctaacattgaaacgatggataatccttctaaaataaaagcgcagacgaaagcctcttctttcacgctgattgtcgcctttatatgcgtggcgttgattggtttggccttgattcccctgctccccgtaaaactgaatccttcaagaactttaccgggttttacggtacagttcagtatgcccggcacttcgtcgagggtagtggagatagaggcaaccagtaaactggaggccatgttggcacgtattaaaggtataaagaacatctattctacctccgataacggttcggggagcatcaccattgaattggacaagtatgcggatatagatgcggtacgttttgaggcatcaaccattatccggcagacctggcctcagcttcccgacggagtgagctatccctatatcaggatgaagcgtccggacgataatgcctcacgtcctttcatgtcgtttacacttaatgctccttctactcccatcttgattcagcaatatgccgatgaacatatcaagacgaggctggcacagattcagggtatctataagatagacttgagcggagccacacccatggagtgggtgttggagtatgatagcgaacaactgagacgattgggtatttctttgagcgatatccagcaggctgttgcccgctattatcaaaaagagtttctgggaacttataatatcgagtcggcttcaggtggtaaagagtggatccggctggccctgatgcccgagtataaagaggaaggattcgatgcttcccgtatccgggtgaaaagtacagaaggaaaattgatcagtctgaacgagcttgtaacggtgagccacatggaggaagctcctcagagctattatcgtatcaacggacttaactccatttatttgtcgattacagccgaggaaactgccaaccagttgcaactgagtacacaggttaaagaagagatggaggcgatacagaaagtgttgcctgccggatatgagatccacacaagctacgatgctacggaatttattcacgaagagctgaataagatttatttgcgtaccgggcttacggtcctgattctgctgttttttgtgctgcttatcacgttgaatccacgctatttgtttttgatcgtggtcagtctgagtatcaatatagccgtggcggtgattttctattaccttttcggactggaaatgcagctctactcgctcgccggtattacggtttcgctcaatctggtgatagacaatacgattgtgatgaccgaccatatcctgcaccggcgtaacctgaaagcctttatgtccattctggctgcgaccctgactacaatgggagctttggtcatcattttcttccttgacgagaagatacggttgaatctgcaagattttgcagccgtagtgattatcaatctggctgtatctctgttcgtagctcttttcttcgtaccggctctgatcgaaaagatcgggttaagaaagagaaagcgccgtcagaccaaatcccgtttcttccttcttcgtgcttctcttccgcggagaataacagtttactttacccgtttctatggctggatgatacgtaaattatgccgttggcgtgtggttgtctgcatcttgttggtactgttgttcggacttccggtatttatgctgccggaaaagatggaaggtgaagggcgtgccgtggagtggtataacaagaccttaggatcatctacttacaaagaaaaagtgaaaccggttgtggacaaagcactgggaggcagtttgcgcctgtttatccagaaggtatacgaaggcagttatttcacccggaacgaagaagtggtattgtatgttcatgccaatcttccgaacggcagtacgttggagcagatgaatgaactgatcaaaaagatggagatttatctgagtcagtttaaggaaatcaaacagttccagacttcggtgtacagtgcccgtcgtggtaatattaatgtctattttaccaaagagcatcagaatagcggtttcccctatacactgaaagcaaatattatcagcaaagccttgcaattgggtggaggcagttggggggtatacggtttgcaggatcaggggttcagtaatgatgtgcgtgagggagccggttccttccaggtgaagatgtatggatacaattacgatgaattgtatgaatgggctgagaagttgaaagccaaattgctgactcaccgacggatcaaggaagttataataaactcttatttctcttattggaaagacgattatcaagagttctactttgacctcaaccgggaacgtatggcacaggagaacatcaatgccaatattctgttctctacgatccgccctatttatggtaagaatatggagatcggatcggtagtggcggataatggttcggaaaaaataaagctttcctccaaacagtctcaggagtatgacatttgggccatgcaatattttccgtacggaacggatgacaaacagtataaactgtctgaactggctactatggaaaagggacaaatgccgcaacaggttgccaaagagaatcagcaatacaggttgtgcctgcaatacgaatatatcggttcgggggaacaaggaaataaaattctgaaacgtgacctggaggagtttaacaaagaactcccgatggggtatacggctcaatcggagcgggatagctggggatggggaaagaaagataataagcaatatctgcttttgctggtagtgattgccattatctttttcacgacaagtatcttgtttaattcattgaaacagcctctggctatcatatttattattccggtgtcatatatcggtgtattcctgacgttctattggtttaagctgaactttgaccagggaggttttgcttcgtttgttttattgtgtggtattacggtgaacgccagtatctatattcttaacgagtataacgccattcgtagacgttctccccgaatgtcggccttgagggcctataccaaggcttggaatgcgaagatcattcctatcttcctgacagttgtctctacgatccttggctttattcctttcatggtaggtacagataaggaagcattctggttcccattggccgcaggaaccatcggtgggttagtcatgtcaatcatcggaatcttcttcttccttccggtatttgtgctgaagaagagagtggggaaacgatgaacaaatactctttccaccacagagggcacggagtaacacagagaagaaatgaagttattgattagggatattcctaaaataagaaaattaaaggcaactgattcattgcgggttagttgccttttttgtatctttaagcagggacatttactgaatatccctgcttatcaataaaaaaactctgtgttactctgtgccctctgtggtgaatcctgttcatcgttcaaaaccgtttataagtcttgatcttcattcttcaccatccctttgaatttatcggggagtgcactttctacagcagtataggcttctgccatggtagctttaatgttatccgctccctgacctttcggggggatagggtcatgtatggtcagaatcatgcggtggcggtgaatccatttgccggttcgtggcaggatttcaaaagatccgtctatggtcacaggaactacggcaagttggaggtcgtccgccagttgaaaagctcctttcttaaaatatcccatatggccggtgaaagaccgtgccccttccgggaagaccactaatgacacaccgtccttcagagagtctttggcctggcgaatggtttcaagtaccttcttcggacccgaccggtctacgaaaatatgtccggcactttcgcatgcttttcctacaaaaggtattttacggagacttttcttcatcatccatttaaagttacgtcctaaaaagccgtaaatgaggaagatgtcgaacgagccttgatgattgggtacgaagatgtaagaggttcttccatgtagcttttcgcgtccacgcacttttaccggaatcaacaggaaaaggcagatcaactgtgaccagattttccccggataatatccccagatgtgggcacctcccaataatgaaccaatgatggtgacaatcgccgtgaggatagtcaatactaacaaaatgggcaatgcaatgcagatttgataaatatagtatagtatcttcataatgattttggttttagcttgtgcaaaaataaacaaaataatattgctgtcctgaataattgctaactttgtttcaaatttcaatagcatgatacgtatactacatacagccgattggcatttgggacaaacctttttcggatatgaccggacacaggaacatgaacactttctggactggctggccggtgtcctgactaagaacaaaattgatgtactgattgttgccggagacgttttcgatgtttccaatccgtctgccgcctcgcagcgaatgttctatcgtttcattcaccgggtgacaaccgagaacccgggattgcagttggtcattgtagccggaaaccatgattcggctgcccggttggagtcacctctgccgttgttgcaggagatgcggacggagattaaggggattgtccgtaaacagaatggcaaaatagattatgagcatttgctggtagaattgaagaatgcggcgggggaggtagaagcactatgcctggcggtacctttcttgcgacagggagactatccggtggtagagactgaaggcaatccgtatgcggaaggagtaaaggaactgtatgcccgtttggtggaatatgctttgaagaagcggacggacgggcaggcattggtggctgtcggacatttgctggcaaccggttcggagattgccgaaaaagatcatagtgagcgcatcatcatcggcggtttggagagtgtatcgcccgagtctttttccgaacaaattgtttatacggctttagggcatatccataaggctcagcgcgtatcgggaagggagaatatccgttatgccggcagtcccttacctatgtcgtttgccgagaagcattatcaccacggagtggtaaaagtgattctggatgaaggttgggcagtcgaaatagagaaacttgaatatacacctttggtacgtttgctgagtatacccgccaaagagccagcggctccggacgaggtactggatgaattgtgcagactggaacttccggagaatggaccgaagccctatctggaagtcaaggtgaaactaagtgaaccggagccgatgttgcggcagcaaatagaagaaatactggaaggcaagccggtccggctggcccgtattgtttcttcttacagacaggcggcagaggggagcgtggaagaagaagtactggctgccggattgcaggagatgaatcccttacagattgtgaaagcaacctttgagaacagttaccagacggagatgccggaagaactggtaaaactgtttcaggaggcttgccggacaatcaatttagaatgaatcaaataagaactcgaggctgtgtcgaaactcttttcactacagagtatcacagagtatcacagagttttttactaataatcagtaacttaaaaacacctctgtgttactctgtgtcctctgtggtgagttatgatacaccctctaaagcaaaccgaataaccatgaagatactaaccatacgattaaagaacctggcttccatagaaggaacctttgaaattgatttccaagccgagcctttacgttctgccgggatttttgcgatatccggtcctacgggagccggaaaatcgacaatactggatgcactctgtctggcactgtatgataagacacctcgcttttccgcttcggtcgagagtctttatatgtcagatatcggtgaaagtcgggtgaatcaggccgatgtgaagaatatccttcggagagggacgggagagggatttgccgaggttgattttttaggagcgtccggacactgttatcgttctcgttggtcggtacgccggacaggaagccgggctaacggttctctgcggtcgcagacgatacaagtgaccgatctgactgccaatcaggaactgcagggaacaaggaaagagttgttggcacaattggtgattttggttggtttgacttacgaacagttcacccgtacggtgctacttgcccagaatgactttgctactttcttgaaatcccgtgagtccgccaaagccgagttgctcgagaagctgaccggaacggagatatactcccgcatttccagtgaaatctttctgcgtagcaaaacagctgatgcagaactgaatctgttgaaaagcaatgccaccctgatcgaactgctttccgaagaggaaatcagtcttcttcagacagaaaaagggagtctggtcagccttcgtgaacagggaagtaaagccttggtagaattgaatgcgcaactatcggtgctgcatactttgaagttgcaacaggaacagcgtgataagaaagtgcaggacatgcggctggatgaagaaaaaagtaagaagctccgggaagaacacacacgccagtccgactatcttattcacttcaggggacagtgcgaagccgtgcaacccgatcttagccgagcacgtgaactggatgttcagatccaatcactggtcagccaatctaagcaggcggaggagatactgcaaggtgctgaaaaggcagcgactgcacaagccgataaattgcaatctgtgcagggaactctgcatacttcctgccatgcgttgaagaacctgacgggagagatcgatctaccggttacggaagagacggggctgtttcttgaatctgtccggaacaggctgaaagagcaggaagaccaccttgccattcttcagaaagagaacgaagagcgtgtgaaccgtctgaacgcttttggggttgaagcggtgactgacgagcaagcccgatggatgcaggaacaaacccgtttgcagaatgcccgccagcaaatgttggaatggggaaaggcgaggacagaagccgaacgtctgaaagtacagcaggaagaggtggtgcacaaacaagaacagatgcggaaagaaatggccgctctgaccacccggttggcggagaaggagactgaactgaaagtgctgcaacgcctttttgagaatgcccgtatcgcgatgggaaaggacgttaggacattgcggcagaatttgcgtgagaatgaaccgtgtccggtatgtgggagcactgatcatccttatagaaacgaggagcaggtagtccataccctgtatcacaacatcgaattggagtatcaaaccgcatctggtgagtatcagcaactaaataaccggaatatcgccttgaaacaggatttgttccatcagacggaactgtccggacagataaccgtacagttgcaggcgttgctccaggaggttgagcagaagcgtccttcatcggaagaggagcaaaatccggactattttgagaaacaactgcataccgtacaagggaagctaaatctgctcgcagagaaaatgcgccaataccagcaactccataaggaatggcaacagcacgaggagcggatcaggacacttcgctcggcttgtgaggctttgcgtgaaggtgtagcccgctgccatctgttgatgcagcaagttctggctgctaaagagcaatttacgttactgaaaacggcggagatgactgctcgggaacagttccgggtggtcagtgagcggttgataactctccgtcaggaacgggctcctctgttgaaaggcaaatctgttgaggatgcggaagccgccattcggaaaaaagagaaacaattaaacgactccctggaacaggtgcgcaaggagggagaagaagtccagtcgcgtatttccggcatacagggagagatcaggcaactgaacagttccatcgacgaactgatgcttcggaaagaacagatagccgatccggaacatctgccggagacgatcgcccgccagcaagcaaccaatcaggagacggaacgtcgtctgtccaccgtagaggcacgtcttttgcaacaggagcaaaaccagaagaagctgaggcagctggaacaggaactgaccgaaaaacaggagacggccaaccgatggggaaaactcaataaactgattggcagtgcggacgggacaaaatttaaggtgattgcgcaaagctatacgttgaatctgttactgatgcatgccaacaaacatctgtcttatctctcgaaacgttaccgtttgcagcaggtgccgggaacactcgccctgcaagtgatcgactgcgatatgtgtgacgaggtgcgtaccgtctactctctttccggcggagaatcttttcttatctccctggcgctggccctcgggctgtcgtctctttcgagcaataacctgagagtggagtcacttttcatcgacgaaggattcggttcgctcgatgccgatagtttacgcactgtgatggaagctctcgagcagttgcagatgcaaggacggaagatcggagttatctcgcatgtgcaggagatgagtgagcgcattgccgtacaggtacaactccatcgtgcggcgaatgggaagagtgctatcactttgacaaattgataatcggaaatcgtttggctgcgttttttcagggcggacggcgagctgaacggaaaaaacgccttattttagcttctctgattaccggatggaaagaaaattttcgtgtttgccggtagaatgtaagtgaggctacgcaatctcttccgtaacgtacgtaagaaaggaagaatcgtgtctttttattgttcgggtaaactcttgtaaggactcacaactggagaaaaaacaggtccgataagctaagaaaatgctaacaacagatgtaatgaacaaaaacaataggagatatttgaaaaagaagtaagcatattccgaaaatgcttacttctttcggaccgaatgcttacttcttttccgggaaatgcttactgcttttgccgaaaatcccggctcttcacctcttcaaccccggctcttcacctccgtaagaccggctttccggcttttcttcctctggtttgccgttttttaaaagagagtctatttgcaaaacagcttatttcctttcttaatgtattcctatctgtcgtgattcctttctttatgatatttcccctgtcccggatatcgaacccggttctcctccatatcctcctttgtggcggatactttacttgaactgctcttcgttcagcgagtagtattttcctttcagtgcgagtagctcctgatggctgccttgctcgataatctccccgtgttccagcaccagaatcgtatcagcattgcggatggtagacaggcggtgagcaataatcaggctggtgcgtccttgcatcaattggtccagtcctttttgaatcagtatttcactgcgtgtatcgatgttgcttgtcgcctcgtccagcagcaggatagccggatcggccactgccgcgcgggcgatgttcagtagctgccgttgtccctgactcaggtttgccccgtcattttcgagtagcgtgtcgtagccctgtggcaaacgtttgatgaatgaatgggccgctgtcagccgtgcagccgccactacctcttcatcggtcgcgttgaggcggccgaaacggatgttctcccgtaccgtacccgtgaaaagatgtgtatcctgcagtacgatggccatcgatcggcgaaggctgtcacgcctgatacggtcgatgggatgattgtcgatggtaatctctccggactgaatgtcaaagaagcgcggcagcaggttcagtatggttgtctttcctgctccggtagcgcccaccaaagctatcttctttccggcagccgcatgcagggatactcctttcaggatggttttttccggacggtagccgaaatatacattctttaaggctacatctccttttgttttttcgagtgtgatggcatctggcgcatcctcctgctccggtgcttcgtctatgatctcgaagatgcgttcggctccggcaatggctgcctgtatgctgttgtagaggctcgccagttcattgatggggcgtccgaattgccgggaatattgcaggaaagccgccagtccgcccacgtcgaacccgcggaagatggccagtaaggctcccacgatggtgatgatcacatagttcagcgtattcaggttttgcatgaccggcatcatcagccccgagtagaattgtgccttcagcgatttctccttcaggctttggttcagtatcccgaaatccgtttccactttttgttcgtgtccgaagaccttcaccactttctgtccgctgatcatttcttccacatagccgttcatcatccccaatgactcctgttgtgctttgaagtatttccggcttcgtttcacgattcctttggcgctgaggaacatcagggggacggtaatcagtgttactgctgtcagtatcggactgatgaagagcatcagacagaaaatgcccgcaactgtcagtgcgctcgacaacatgtcggacaggctgtcggtcagtgcgtcgctgatacggtctatatcattggtgtaccggctcatgacatctccgtgctgatgggtatcgaagtatttgacaggcaagcgttccatctttccgaacagttcttcgcgcatccgggttacggtgcgttgcccgatcttattcagcagaatatattcgatgtaagtagccgctacccctgtcaggtaaatgcctgccagtatcagcaggatgcgtaccaatccgtggaagtctcccggcaggatgtagttattgataatcggtcggagcatgtacgatccggtgagattggctgcgatgctcacaacgatcagtacaccgattacgatcagcaaccgtcggtcgcaggccacgtacgataccaggcggaggaaagttttctttcccgccttaggctttccgctgtatttcagatgatctccgtgtgccatggtcagataacgatttgttgtgagtgatagatttcccggtacatctccgagcgttccagcaattcttccggtgttccgatggattctacctctccgtcgtccagcagaatgacccggttggccgattgcatggtatatatgcgttgcgtgatgataagcaccgtggtatcgtgcagccatgcattcaggttgttccggatgcggagttctgtttcagagtctacggcactggtgctgtcatccagtatcaatatcttgggtttacgcagcaaagccctggcgatgcagatgcgttgcttctgtccgccggaaaggtttactccgccccgtcctaactgcgtgtcatatccggcaggcagcgagcggatgaactcatgggcttcggcggcacgtgcggcctcttcaagttctttctgtgtggcatcgggttttccccaccgcaggttttctgcaatggttcccgtaaagagctcgtttttctgcaacaccatgccgatgcgggcatgaagttcgtgcaggttgtagtcttgtacggggatgccgtcaatccgtatttcaccggaactgacatcatacaggcgggggatcagttgtacgagcgaacttttagccgatccggtagcacctgccacagccactgtctcgcccggacgaacgtggaaacttatgttccgcagcacatccgtctcgcctccgccataacggaagctgaccttctcaaagcgaatctctcccttttcgatctgccgggtgctacgcattccttcgggcgtatcggtcagtgaaggctgtgtatccaatacctccaggatacgtttcgatgaggctgaggcacgggcataagtcatgataatcatggacagcatcatcaacgacatcagcacttgtgccagatagttgacaaatgatatcagttcgcccactttcaactctcctgccatcaccttctgcccacccatccaaaggatagcgatgatcgacaggttcatcaccagttgcatcaccggaaagatggcgacaatgatgttggaagcgtgaattaccgtgtcgcgcaggcttttgctcttgtccttgaacttgcgtgcttcgaagtcctcccgcacaaatgatttcactacccggatgttgatcaggttttcgcgtaccacttcgttcagttggtctactttctgttgcactttcaagaagaaggggaaccctttccgcaggatgaagaatacactgaaacccaacaccgggatggcagccagcaggacgcctgccagttccgggttgatacgtaccacgaagaatactgccatgacgagcatcagcggagagcgcagcatcagacgcatcgatacctggataacttgctgaatgcggctgatgtcacttgtcagccgggtgatcagtgaagccgtactgaaccggtctatatcgaaaaaagagagttgttgtatcttgccgaacagcttggtgcgcagatcggttccgaaaccgatggaggcttgcgaagagacatatacattggcaatactgaatatcagtccgacaatggagataagtaccatctttccgcctacggcagtaatgacggagagatcccgctgcatcactccgttgtctataatatccgccatgtacatcggctgaatggtttcgcacattacagacacgagtaccagtagcggacatgccagcagacttgctttgtagcctttcagtatttgccagtattttttcatttatccagtgtaatcacggtaatctccggccatgccccgaaacggaaaggcagtccgacgaatcccatccctacgtttacgtatagtccccggttgccttctttgtacatgcctccccattccggatagatccaggaagcaggtgaatgatgtccgatggccagctgcatggcatgcgtgtgtcccgccagcatcaggtcgatgtccgattcgggcaacacttcacgtctccagtgtgtaggattatgacttaataacagcttgaacaggccgtttgttcctgcctgtgccttgggcaagtcaccgtgctgtgagaaaggaggttctccttcgttttctaccccgatcagggcgatgctgtcgtttccgcggtgcagtagagtgtgctcgttgttcagtaacacccagcccatgtcggcttgccgtttcttcaggtcgttcaggttgtttacctggtcgcgtttacttttccatcgatagtaggggccgtagtcatggtttcccaggatggagtatacgccgtcccgggcatgtagttgcgagagtatctcttcaaatccgtccaattctatggcccggttgtttatcaggtcaccggtgaatacgatcaagtccggcttttgcgcgttaaccaggtccaccatctgttgcaggctcttggcatttccttgccagctcccgatgtgtatgtccgacaactggacaatgcggtatccgttgaaagcttcgggcaggcgggaagaacggaaggtgacctcctttacttcaaaacggtctttgcccaccatcgaaccataaagtatcaggactgcgttgagcacggccagtaccagtccggttgctataaaaggagtccggggccagtgcagccatcggttgaacgggcgtccgatgatggaacagatcgtaaagagcagtttcggagaggcaaacaagaagaagacaacggcgaagcgtcctatccataacgtatgttgttcggcgtattcatagttggcaaagaaagctaacgatactactcccgccatcaggaaaagagtggggaagaagtaaaggattcgccaaaaaagacttagagtcatttgtttgataaatgtccggtaaatgtaaatgtccggcaatacaaggattacgatcagaaagcctaaaactcgttgcagcatattttcttagctatgggttgaataaataaaaagaggcgtagggtatgtctcggggggacttgcgaacgcctcttcaaagttagagagaatttgtaaagtacggtttaagttaagctgtatgatttaattcttttaactcgtttaggttcttctttatttcttttatatgtctgaggttccggcgatacacccacaggcagattccaagtccgacggcccacacgatcagactgctgatgattcctgcagcaccgtattgccagacctgtttgtagaaagagaaaaaggtagccatcacaagcaggtagagtatgcctatgatccattcgcgaaccatccatctgtgatatcggttgatacgggagattactgtgaccagaggcatttcatctatccgggtccgccccaggtaatgggcggaatacaaatcccagcaaagggccgggatgcacaggaagagggcgatccaataataaaagtccgtaagtgcatcatcacatatccagaggatcactgccaatgccagtatgccgattgcggcaaaacgcagctttctgttgaaccgttctatgctgttaatgttgttccgggtgcgtcccaacaattgtttcatttcttcttccttgatgaactccttgcctttgaggtgttcatccagtgcgttccacgatttcttcagatcatccagttccatatcttattcctcctttttcatcttttttagtttgtctttaatccggctcagcttggttgctacattggtcactgtcagtccggtgatttccgagatttcctcgtaacttttctcttccagataaagcaatatgatcgacttatccagttgtcccagttgattgatcatccggtacagttgccggagcatttccgtcagttcgtctttttcttccgtcagccagtcggcttcgcgggtgagtgccacgatttccggaatgtttttctctttgcggataaagctgatgcaagtgttcagtgcgatccggtaaatccaggtcgagactttgcactctttccggaatctgggataagccttccacagattgagaatcacttcctgataaagatcgccgagtgtggcgtgctgggtggtataaagatagcacaccttgtaaatcacccgctcgtactccctgactacggagaggaactcttgttctacgggttcgttggcttgcggcggactggtggggttcattgtcttcttttcgggattacttttgtatggttagtcgcaaaggaaaggaaataatcacaaaataaaagcggaaattagtgggaatttggactatttccggatatttattatatttggaaacgataagaatctgtgggtgacggagtttgtcaagtatgaaacgttttaaataaatccgtatttttatgactggatgtacaagtatggcttcaaatagcgaggacctgaaggcctttattttatctttggaagaacaagctctgaagttatggaatcgtggaaacccggatgggtttatagaactgtcatctgatgatgttgtctatatcgaccctgctttcaagaacaaactggaaggtaaaaaggctctggaagagtattataacagcattcggggaaaagtcgagatcgacaggtataatatgatagaacccactgtattgctgtcatccgatgtcgctgttctggcatatgattatgaagcttatagagatgaccggacattcaggatgcattgtacggaagtatttaaactggattcgtctgaacagtggaaaatcatacatacccattggtctttttgtcctgtctgataatggcggacagaatgggaatggccgaatcttttccctacaggaggatgccgggatattgaatcccataatatcccatccatacctgaatcatgctttcttcacaacagtttgtctctgtatctttgtaatacttcttttggatatgtagttttgtcacgtcttcttgtatgtcactggaagagaggacagaggtacttcggatttgtttggaatcaaactgttttcttttgttatatttataacccgttggcggaattaacttagtgcgtatttaattctgccaataggcttgttatcttaactccccatccttgcctggctcagtctcggagtcatcgggttcgcccgcgccgccgagctgataatacgcataaaatccttcgtgcccatcagccgctcaaacgttcggaacagcgccatcagatacttccactccacaaagttccgaagcacccatgccgtcacaccgatacccacatgtcgcgacacatagccacggcacaccgtataggccagcagacggctcacagccttgccatgttccgctacaaagcttagttcctcggtcttgtccttcggctgccacccgggttctacacccatcttcaggtattccctcgccagcaggatctgcccgcgcagtcgcgggcgcttcatcgtcacacgcacctccagcgggcgtttcagccatgggagcttccaccttttaagaggaacggacacgccgctgtccagcagcgcatccgcacactccatttctatcagttgttccagccggtcagccatacactatccctccttgcttgtggtctcctcactttgaaccgaggcagcagccgctgctcccgcagcaggcagcttgtgctctccccactcttcgggcagggtttccgagtcaaacacgccgtagggctgcgaaccgtcctccggcatagccacctccagcgtacattctatcttcgccgtttccgtcagcgtcagcttaccgcccaggttgctcagcagcgtgccgttcggtatcaggatgctccgtccgctcaccagtgccagttcgaaaggaccttgcatcagcagggcggcttgtggggcggtccagcctattgggttcttcttctggttgtcttctttcgcatagtgcagcgtgccgcccagcagggcatgcaggttcttgtagtccgtctggattacgttgaatgtgggggcgatgctgccgttgctctgcggaatgatcagcacgggggcacccggtgcctgttccgcctcaatctttgcggcttcgggcttctgcccgttcaggtcaaacgagcctttctcgatatagcctatcacgaagtcattgtatttcacggctcccaggccgtacataaaattcttgttcatcttcttttcaatttcatggttaataacacaccggccaagatgccggccaatacacctgtcataaacgtccgcatccggttcggagggcgtttttctaccgtttgaacgtcatttgaaatttcactcttggtttcgctacggatgcgcgccagctcttcttcataccacagcaccaactgttgcaggctgtcacacgaggcttcggccacaatgttaccgctaccgtcgctgcctaccgtcaggttggcctggccgctcttcccgcgatacaccgcgccttcaggaagtttacggaggctgtccgcaggtatagacagcttcaccgaactcgccggtacccccgccatcaccagtcccgcccgtcggcttccgctcgcgctgtcggcgcttgccgtttccgtctgtgtcttctccgccgtcatgctcttcctgctgcttgcgcagcccgccaagcacaggacagtcatcatgatgacggcaactgttggcagtgtcaatggccttgcgcagtcgcgccatttcgcgcttgttggcctgcaggtcttttcttgttgcattcagttcttcttttaagggtaccacaatgttgcttaccaaaacgcgggtggcatgttccgcgttgtccacacgcacaccctccgcgtcggcttcggccttcatcgcttccgctttcgctttcctcaccgtggcacgcaatgacccgatggctgctgcagtgcccacaaggccgccgctaagaatgatgttcataatctcactaaagtccataccacccgttttttagtcagtcaaccttttatgctgcttcctcgcgtttcttgcggaataacccgataacccactgcaccagtcccgtgtcagccacgccgttggccacaagcgaggcaccaaagccatacagcaaggcaatgtcccagctcacatcactcacaaaccccgcatcaagccaccacagcagcatcacgcataccaggcccacacaccagcttaccagctgcgtcacccagcctttcatattagggaacaagcccttcaaaccttcggtaagcaccaccacaccggctgcaaaaccggcaaaggtgccaatcattgcgtcatagtccgttgccggaacatcggtcccttgggccatcacagccgataccacaccgagcatcagcatcataaacagcatcattcgtttcattgattgtttcttttattattggttaatacctatttctttcagccatttctgtacatcaaagctggggcaggctttggccgccagctcgttgtgtcccacaatgcgcacatccgggaatctgcggtggaagtccttcacatacttctccagtgcctttttctggcagccggtacgcgtgtccttcggggtcttgccatccttggccacaccgccggcatacacaatgtggcggctcacgctgttgtatcccttcgcgccgttcgtcacttcccacggatccacctgcgcatcctcgttgttgttcaccagtcgttccactccgccctgcaggtggaacaggtcggtgtagcccacctgtttccagcctcggccgccctggctcacgggcgaagtgtgccacttccggatgtccgccgatgatacctcacgcccctccggcgttgccgtacaatgaattaccagatacttcaactttgccataccatcttatcctttctggttttgggtaatggtaatcttggccgtcttgctgcggtcggcattgagtgtaagggtcagcgtaccggttttctgactgccactgtttgcaccggccgaaatcttcacaccgttatccgtcgcttccaccttgaagccggcaggggcactgccaatctcatattctccactcgcggtcacagtcacctcctcgctgccaccggttgcctcaagggtcacactggcaggatcaactgaaatcttcttctcgctcgccttgaacacggggttgcttcgcttgtccagcaccaccacttcttcgccgaaggcaatgttcgtgtcagccttcatcagcatcttgaagaagtacagttcgcttgcgttcgaaatcttgtcaatctgaatcacgtcttcatcgtcctgcaggttcacagccgcaaacaggttgccgccggcatcgggcgaacagagggtgcacacaatcagatcatcgggccaggcggcaagcgtctctatggtaatgcccttgtagcggcgggcattcacgtcggtttcgctcgtgttctttgcctcgcgctgggtcagttcgtcgtcatacttgtcaaagtcgttcacactcatcaggatgcggaggtccgggttgttgcggatggctacaggaatcttcgcacgcatagctttcagtctgcccagcatggtcgattctgcgctgtccaccacaatcacctcagtatccttggccatctgggtcaggatgccgttaaacaggtggtcgtcatcatccccatattcgccgttcacatagtggtcacccagttcaaattgcacctgtttggccagctcggcaagcagggcgttctgcgcttcgggcggaagttccgagaataccaggttgcccttcggctgccacttgcgccagatgttctcgaacgtgcgggggttaaataccgtaaaggccatgaagtccaccgggtcaaggctcttctcgtcgtagttgaagtttcccttcgaatcctccacaccggggttctccttgcgcttctgaagcatcttgccggtcttcaggcggggaaggctgattttcttttccacaccgggaatcaccataatcagccccttttccacaatctcattgctcgtagcggcaagcgtcagcaactgttccagtacctcgccgctgtaattcgtgtttcttacaattattgccatagttcaatcactttttacgtttgtcctttatttctcgcatgcgcttggcccagggactctcatctccgttcggttccaggtgcaggtcttccatcacacggcgcttcaccggcagttgggccagggccttttcgccgttctcgcggtcattggccaaaaggttttcgtagatggggcgggtggtcgcatcgatgcggccgtcttgctcggctgcgtcaagcagctgcttgcgggcggcaaggtcttcggctgcagccttgtcctcgtaggtcttcaccttggccttcaggtcggtgttctctttcgtaaggacaggtaccttgccggcctcttcctccagttggtccatcaggcggaacacatccgcatcactcgcgcagtccttgaagcgcgggcgtttctttacgtcttccagattcatgtcttctctgttgttttgtggctcaatgagccggttattgaataaagtatatatctgtgccggcgtactgtcggccggcacggggtctgcatcatagatgccgtctatgaaaccgaggtccagggcttcctgggcagtcagccagtggtcctcgccgtcaaaataggtctgtttcacttcttcctggctcatgcccagtcgctcggcatagatttcgctcaagctgccctccaggctttctatctcttccatgcagcgctgcaggtcctgcttgttgccgtaacacccgccactcacactgtgcagcatcagacgggcatatttgctcatttctacgggcttgccgcaaagggctatcacactggccatgctggcggctatgccatccacataaatgcggatgtcggcctggctatggcgcagggcgttgaatatcgcaatgccgctgtacacttccccgccgttgctgttgatacgcacatggatgcgccggctcacgcgttcggcttccatcagttcctgggctatgcgcccgctttgcacctccgtatagtctccgatgtccccgtacaggaatatcgtactggtgccgtcgtcactcgttgtaatattgaaaaatctgctcatcgtcatgtctttaccagcggtttccccgcctttcgatggtgcgaaaatagaacattcccatggcaacaagaaaccgcgtccgcatcataacgttttctggcgttatcataacgctgtaacccgtcatcatgcgtacgcgcttttacaaaccccgctttttcatgcaattttgtaacgtgatttacaactaaaaaggacgatttatggcagatttgacgaatgcccagaaaaaggaatgggcaaagactttgtacctcaaggaaaacctcacacagcaggaaattgccgaccgggtgggcgtgtcacgggtgtccgtatccaactgggtgcgggccgggaagtgggaggaacagaaggtggggcttacgctcacaaggcaggaacaggtggctaacctctaccgacaggtggccgaaataaacaaggctattgccgaacggcccgaaggggaacggttcccctcatccaaggaggcggacattctcggaaaactgtcggcagccatacgcaacatggagcaggaagtgggcattgccgacatcatcagtgtcctcaccgggctcatcgattgggtgcgggcagccgacctcgaaaaggctaaggaaatcacacgcctggccgatgcgtacattaaagacaaattataaaggagacagaccatgaaacagactgacagactcgctctcctcgattgggagaagtacaaagaagacatcgcaagggctacaccggttgaccggaacatgacggcagccgaacgggaaaaacaccgggaatatctggagaaacatcccatagaatggatcaggttctttttcccgaattatgccaaatatgaatttgccggcttccagaaaaaggctatccggcggatcattgcacacgatgaatggtttgaggtgctttcttggagccgtgagctggccaaatccaccgtcactatgttcatcgtcatgtatctcacgctgaccggacgcaaaaagaatgtgattctgacctccaacagcaaggacaatgcagtgcgcctgctcgatccgtaccgggccaacctcgaagccaacggacgcatcatggcatactacggcaaacaggaaatgccgggctcatggaccgaggatgaattcaccaccaaaggaaaggtttctttccgcgcactgggtgccgggcagtcaccgcgtggctcgcgtaacgaggccatacgtcccgacgtgctgctggtcgatgactttgatacggacgaggacaccaagaatccggacatcatccagaagcgttgggactggtgggaaaatgcgctgtaccccacacgttccatttctgaacctacactggtcatcttctgcggcaacatcattgccaaggactgctgcgtggtgagggcaggcgaaatggccgactcctgggacatcgtaaacatccgcgacaaaaacggattttccacatggccggaaaagaactcggaagaggacattgaccgtacactgtccaaaatatccaaaaaggcggcacagggtgaatattacaacaaccccatttccgagggcgaggtcttcgagaacatttcatacggcaagataccgcctctctccaaattcaagtttctcgtggcgtatggcgacccggcaccgggcgaaagcaaggggaagaaaggaaaatcattcaagacggtttcactttgtggcaaattgggcaccaggctctatgtcatcaagactttcctggcgcaggcactcaatgcggagttcattgactggtatgtccggatgcttgattttgtcgggggcaagaccaatgtttattgctacatggaaaacaacaaactgcaggacccttttttccagcaggtgttcaaaccgctggtggcaaaggtgcgacgggaacagaagattgcactgttcatccggggcgacgaggagaagaagacggacaaggctacacgtatcgaggccaaccttgaaccgctcaaccgcgaagggaaccttatcctcaacgaggctgaacgggacaacccgcacatgaaggaactggaggaccagttcaagctgttcaccttgaccatgcgctatccggccgacggaccggatgcggtcgaaggggcgaaccgcatcatcgatgaactgatcaggcgcatcgaaccgcccgttttccgctcaaggaaggatgtgagaaaacggaacaagaaaagattatgacaactctaaaatattaggactatgagcaaatttgtagaactcaccgattacgatgcgagtatccaccgcgacattcttgacgcactggtgcgcgaagacgaaacggtcattgaggtttgcgaggacagggccattgccgaaatgcgatgctacttgggcaaacgctacgactgcaacaagatttttgctgccaccggcgagaaccggaaccagctcgtgctgatgatggtcattgacatggcggtctatcacatcttctgcatccacaacccgcagaaactttcccaggtacgcaaggaccgatacgaacgggcagtggaatggatgaaggcggtggccgacgaggatatatcaatcgaaggggctccgctgctacccgaagaacaaagggcaggcagatcggatttccgcattcaaagcaaccgcaaacgtacgaaccactggtaaaaagcaagcagtatgaagaaaaaaaacagaaaaagaaacaaaaccggcatcatcaccgttggtggaaacttcgcgttgccgggacaaaagaaaccgaatgtgattgtgctcacacagcccaaacgtttcggactggacatttccgactacatggcagccgtcaaggcggccgagaatgtcgatttttcgcgacgttacaaactctatgacctctacgaggatattctgatggatacccacctttcctgtgtgctcgaaaaacgcaggaatgccgtgctgtgctccaacatggagttccgggtggacgggaagcccgacgataaaatcaaccagcagattcagtcgccctggttcaaccgactggtgggtgacatcctcgatgcgaaattctggggcttctcgctctgccagttctacaagctgcaggagtgggtggactacgacctggtaccgcgtaagcatgtggatccggtcagggaactcatcctgcgccaccagacggacattaccggacattcctgggatgaatataccgacctgctttttgtgggttcacccttcgatttgggactgttggccaaggctgcaccttgggtcatttacaagcgtaacaccacgggcgactgggcacagttctccgaggtattcggcatgcctatccaggaatatatctatgattccgacgacgacgagtcccgtcagcgggccatggaggatgcggccaatgccggaagcctggcgcagttctttcatgccaaggacacggaactcaagctcacggaagccggcaacaaaacggggtctgccgatgtctatgaacgcctctgcgaacggtgcaacaatgaaatatccaaactgatactgggcaatacgctgacaaccgaatcgtccgaaaaaggcacgcaggctttgggtacggttcataagaaggtggaggacaaggtgctggaggctgaccggaaatacgtgctcaatgtgttaaattacgacatgacggacattctgctgcacatgggcatcaatactgaagggggtacattctgcttcccggaaccgaaggaaacagatgcaggcaccaaaatatccatccttacgcagctgaagaagaacttcaacatccccatcgacgacgactatctctatgaggaattcggcatcgacaaaccggccaactacgagcagttgaaggctgaacaaagggaggctgcacaggctgctcagattccaaccccgaagaaggagccggagccagcgaataagggacgggatgatgaaccgacaccgaaacagaaaagaaacttccggaactggctcaaaggttttttcgtgaaagccccggcagacggggcagctttagactggtagtcgacagactgtatgcggctgataatggcagcatctccatggagtttgacttttccgaagaggtgctgcggcgtgccttgctgaacatatacagcagggactttcatccggcaaccgaaatcgaaatcaacctgttcaatgaaatatgggcaaagatggacaaggcggcaaaggaagggttcagcaaatccaaggccattactccggacgaggatttcagaaatgcaatactccggaacaatgccgtattctcggcattcaaggtacatcgtatgcagaatgacatggcacgacttttattggattcaaacggcattttaaaaccgttcgacaaatgggtacaggaagtcttgcccattgcttcccatcaggttcgtcactggctgcggacggagtatgatacggcggtcatccgggcgcatcaggcggctgactggcaacagttcctgcgcgaacgcgatattctgcccaacctcaaatggctaccgtccacctccattcatccgggggctgaccaccgcccgttctggaataccatccggccgattgacgatccgttctggaacaaccaccgaccgggcgaccggtggaactgcaagtgtgaccttacagccaccgatgaagcgccgacagcagtaccggacgaaaatgggcagaataaggcacatgacggtctggaaaacaatccgggaaaagacggcaaactgttctcagacaaacacccctacgttactgaagcgtatccgggagcaaaaaaagccgtggacgcactgaccagacgcatcaacgagatgatagtcgaaatgccagacaacctgacgctggaggaaaaaaccgacatcgcccgcaacaatctcaagatagaaaaggcactcggcgttaccaaaggtaagccgatgacatacgaacaggcaaacaagggaaaggaaaatccaaaattcggaaaagaggaaggataccgcgtgaattgccagacctgcaccgtaacacacatgctcagaaggttagggtttgacaccgaagcaaaacccaacatcagacaaagcgcatacaatgaaatggcaaaacaaggtatcacatgggaagaacgtttcctgaaccgggatggaacaaagccggattatgactatacctataaatggcaggtcagaaaggggtatcaagtaatgaacgcaaaccgactgaaggaatacttcagggaaaaattcagagaggacggaatatacgagatatattgtgcctggaaaggcggctctgcacacgtgttctgcgcagaggtgactgaagggaagacaaggttcttcgatccgcaaaccggaaaggatgatgtcagcaattacatacagagcatgaaagccaaccgcgtgggagtgataagaatagacaacaaactgataaatcccaaaattatgggactatttatcaccaaataaacgggaagaaagtgtcagcccctcctcaccgtccaccagacggcaggactgaccgtcgaacagaataaaggtaggaagaccgacaggcaactcaaaaccatccccgtcaacacagcccacagaatagatgcttccttcaggggaactggctgataaaacaacggagttataaccgtggatgtttgctaattctgacacttgttccggtatattcataacgcataaaaggcatattggaagccttggttgcaaagttataaattattcttgaattactaatgattatggacataaaagattttgcagaactgatgaagcggaaacgtgacagactggacagcatgatgcggcgcaaaatgccggtcatggtaggacgtatggccaaagaccatttccaggataacttccgccagggtggttttgttaatggcggtcttcacccttggccaaaatccaaacggctgtcctcgggaggtaccgatgccgccagcaattatggaacgctgctctccggcaggaagcatctgttcaaatcggtcggatatacacccaccgactaccgggtaagggtgttcaacgaggtggtctatgcgcccgtccacaactggggaggggaaatcgatgttaccgtcacagaccgcatgagacgctttgcatgggcaaagttctataaggcttcggggaaaaggaaaaaagccggcacagggcaaaagaaacgtgttaaacggcgttccaaaccgaaggaactgaatccacaggcacagttctggaagaacatggcacttaccaagaaaaagaaactgcacatccgcatcccgcagcgccagttcatgggcgaaagcgaagaattgaacagccgcatacgggagaaggtggagcaggaaattaccaacattttaaacgaataacgatatggacgaaatttttatcgcaatcatggaacagattgcacaggaaatgccggaactctcgctcattgatgaggactacggacaattggaaatgggggcagaagaagaccagtacccggtcaccttcccttgtgtattgattggaaatgccagttccgactggcacgaccttggatatggggtacagaaaagcgaatccatgctgaccgtccggctggctatcgattgttacgacgatacgagctacgcatccggcacgtatgacaaggtaagggaaaggcagcagctggccggtaaattatacaagtcactgcagtgcctgcaatgcacggacaacgcttcgccactggtacgcgagaaaagccgctcgtatgccatgccacattacatcaaggtctatgaaatgacattctcattcaccctgcacgatgaatcggccatgccgtcatcttacggggaatagctcaagctgggcagcggtcaggcggggggctttcaccttgggaacaggcttcagattgtagtctgttccctcacgtgatttccggcggatgatggtcatgatacgttcctcggatataaagaattcgcgctccgacaacacttttaaagcatcgtcgaaccgcaaccgctgtatttctgtccaatagtagtaacggcggcacagtgcctcgtcacgcagcttgatcaattctttatcccgtcctttgcccatatacttgttttctcttacaaaaatagctgattttcatcgaatttaagaacaaaagcgccgcaattataacaactgcggcgctttctgtttacagggttaacggtttccggttacaaacggcagaaactgggttcaatgcgggtccatacaccgttttcagggttacggcggctgaagtagtagttggtggcattgcgctgcaccacgttggcttccttgaacaggcgcatgatgtctgcgtactcttcatcgaacttgtcttccagttcgtagagcttcgaaatgctcttgtagtccagatcgcccatcttgttgcgctccagcagggtcatggccatctgatacatcggatcatccgaacctttctcactgttctgcatgtagcgcttcaggtagtcaatcagacggtcggctgccatgtcggctcgttcatcgaagcctttcaccttgttgcttttcacctccagccggaagtctccgtccgtaatggtgtagctgcgctgttcgtcgcttttcacctggccgtattccttcatcaccttggtaaaggcatcggcttctttttccagccatccgcggaacccggtcacggcattcaccatctcaaggacgttggcctttacttcgtgcataaactcaccgcgtaatgcctcgtaagtttcacgacgggcgatgcggtcttctttctcttcttgctgcagctgggccatcagggctgctcgctgttctttactcagggacttgacgtccacactttgattgttcttttccatgtttaaatcattttgaatgttcattacttgtttttattcctactcgttatcctgcgattctggttcatcgtctatcagcatggcctccccgttggcatacgcccagtcagccagctcgttgaaaaactccgctgcatcctggttctccagatcggatgtcgtaagagtcacgtcttttcttatgcgctcaagcgcttcatgtgcttttttatccatattgttctatttatcggttaaacctccttttcgttggatagcccgcagtttgatggccagttgttccagctccgctgtactaatctgaacaaagggtttgccggctatccgagggttgttgcagaattcgttcacccggttccagtcagtggtgtctatacccaactgttgcatcagcttcagacatacgctgcgtttccgtcgcagttcctcgcgaagtttctgccgccattcatcctgcccggtcagtttctccaaggcacagcagcaggcttcatattccttggaagtcatttcacggaggctttccgtacggtcccacgtgtactgcagaacgatttgcttctttagcccttcccggtctcctgtacagggcagcttgttgaacaatgcgtagaaccgggcgaaattggttacttcctgtgccatgtcatttaccattaagaatcatttcacattccgttgatttggtactgacacgataaattatcttatccggcttcactgatttacctttgtattcagcctcaatttgcttagcaaatatctttttgaactcatcacccattttagaaagtatttctttattgtactccccgcaaaaacctatgcgtgaagattggatttcacgaattgttcctctatataccgtagcggtcaacttcatcaccacaacaccggtttccatttttatttttcccatatcgactaattttattcaaacaacactttaatgccacacgaactggccacgtcaagttccagtttggctcccttgctcagttcccagtccttcagcatatagatatagtcacaagccagcaactgggcaatgtcggcccgcatgtgggctctccaatgagcttcatccggcaatccgttcctgaaagggtttacaggatcatagccttgtgccatcagtttctcctcggcacggctgaaggcttccttgcgctcattcatatcatagtgcgcgatggctccgctgatgtacactttcccggcaccggtcacttcaccacgttgaaaagccttgtgtcgttcccaccgttctggaaccaccacactgtagttgcacgattggcagcagcagccttcttctttcaccgggaacggattgtatccgtagccctcatactctttgccgcagatgcagcacactttcttttcttctttcttttccatcacttcaaatctttaatgtttatttggcaggacggatgccatacctggatattccgggcaaacatcacatccctggtttctatcactacgtgtccctttgtcttggccctgcgcagacggaggtcgctttgtatgttacgctctacccaatcgtccaccacggcctccgcctcctgtcctttcaggagtatctggtacagcttattctcccattccatcattcaaataatcctctatattatcgtccttcaatgttttggcagcaccttcttcccatatcacgtagggttcaccgggcttttccataaagcggcttttgcaccaggctttgaaacagcttaccatgattttcacatcggcatcatattccaccttgcgggcgcttctacctgccggatgaagtccctcggcatggctgatgaagataaacagtttcttgggatgacgttccttgaactccttgtaggtcttgtagttcaagccgctgtattggaagctgtcaataatcacgatgccgggactgccccggcgctgcagacgttcctccagctggtccatcgactcgcggtcaaggataaccaaccgcttgcgcacttcgtccatcttatgccgtttcagactcatctggaacgaaaggccggtgctttcctccaaactgtcataaatcacgcgtccaaagccacacaggtacttggccagctgcatcacaaagctgctctttccgtttccgctggctccccaaataatccaaacgccgctcttggcagggttgcctatcgaggcttgccaagccccggtaaattcataccggggtatcttcatattcagcacctcaccggggctgtacgctctcttcagtttcatgcttgcatcctccttaatttttcgatttcggtatatacgcgccgcaagccacctccggtgctgtgaacaatcttggcaatgtcggaaccgtccggggcattgattttggctacaatggcagcctgtgccttcagaaacttttcacgttcctgcgcatcatccggggtcaccttgctgtaggagtcaccgtagcggctcaacatttcggtatagcccaccttcttgccttcgatggcgcggttgatcttttccttcagcccgtctgcacccatcatataccaggcacagcagcgttccgtagcgttccaaagcgccttcagctccaggaaggcttcatactgcaggtcgccggcttcgtccagaataaccaggggtgtatcaatcgtgcgcaagtaggccaccagatcctcatacacgtcgctgtagcgtccgttgctggtcacaccgaattccttggcaatgtagcgtatcagcttcaacttggtcttcacctggctgcagtccacatatacggcgtgcttgtgctgcttcacgtaagctttcgctgtaaaggtcttgccgatattgggcatatcgcacaggatggcgctcagcccgcttccctggcacacttccagctgcttgctcacaaacacataggtcggggtctgtgctgccagccagggcatttccgtacgcagttgcacgcccagtcttcgggctatgcctacccagttggcatcactgacctgcttttcataattgccccgcttgatggcattgtaaacgctgggggctatgcccagtgcggtggcatggcggttgtcactgggataattttcacggtcggcggctatcgctgccacaatacgttgttttacttcatttgttatttccatttgaatgctgttttaaattcgttctaacgtcgttaattatatcttggctactgcatcatgctcaaaggcactgatgtccatataggctgagtaatcttcttcctcggcttgtgcaggaaggggaacggcttccgcctgtacctctgttatcagtttcgcttcctctttggcaaggatgcccacacgcttgatcttgccgtccttcatcatcttgtcgaactgggctacatacttggactgttcggtataggctgccttgtcgtactcggtctgctcggctgtattctcattgtaacgggctacgggcttgcaggtggcgatatatcgtccgttctggtagatatatacctcgttgatggttccgtcggcatcgggcagataataggcatctaccttgtagttcctcggctccagcttttcgatgatttccgggctgggcagtccgtattggttgtacatcaccgtgcagtaggtgttctgccggatggttgtttcggtgtgctgtccgatgaaccggtaaagaacggccttgtcccaaggtgcaaggttcgggttctgatgggcgcaaagcacatcccaacggctcatgcccggatagcgcttttggttggggtgaggctgtgcgttgaaggtctggatggcgcgtatgtcatcggctaccagttcttcataactataggtcttcaccttgtaggtgttgttcttttcgtcatacaccttttcttccttcgggcggttggcctccagcttggcccaccagcggccgatacctacctgcgtgcgtttctccacaccgtatttcttttcgcggttcttgtgctcggcacgtttttcgcgggagtttccgggattacaccagcggatcaaggggaaaacggtaccggcttgcatcaatccgtcggcaaagtcgcttaccaggtggtgttccacttccagctcggcagggatatacatgccgttccggtccagggtttggaacatgtttcgcatgcagtccaaaaacaactcggtagtcttgtaccggttgtaggcatatcctaccacagcgccgctcaccacatcgtaggcataataggctttcacacggttgccatccttcatcgggcgaggcaggtcgcggtcatcaaggctcaccttgctcaatgagaactcaccgatactgcgcagatggtaggggcggtaggcgttgttgaaatcccattggctcatgtgaagcttggctctaagggccttgttcttggggttgttcaagatattggctaccgtggccgggctcaataccaccggattgccgtccttgtcggtaaagtctgctgggttcaacacctcgccggtctcggggtcgtacagttccagttcaccttgtacgaacatattgtactgctcccacaccgtagtgttgaagggctgctccggttggccatcgatgctcagcagcaggcgctcaatgtcgtaggtcactttccggcggttctggttcatgaacttgcggctgataaggctttcatagccgtgggccttgaagtcattcacacgcttcttgaagcggttggaactcacgggcagggtatgcccgaactctgcctgatagtagctgatggctcctgccagctcgccccagttcaccggaccggccttcatggccttgcgcataaaggtggcatcgtccatcgcacgaagcacggcttcaatgaccgaagcgttcaccgtatattcctgtatgtgttccggaggaagggcatcaccgttgtcaaagcggaaccgggtgtagaattcccgggctttcgcatcgatgtggtaatgaccgataaaccagttcctcaaaatattttctttcatttctccgtattttaattttatccgttcctgaaatcgcaggggcatggtggcaatctctatcagtgcataacttccaagccccttgccttgtcgcacaacgttgatttctttcctggccgccaacttcttgtaattgggtaccgacatgatgggagcaagttcttccatggaaagcatggagggatgatgtcctcgcagcgcacggctcttgctgtagtcggcctttccgtcttcccgaatcaccgggcggtcatcgtaggtcaaatccttgtatgatatgcacaatatctttccataatactccatttcattgctgtttataaggcggctgccatctgttgggtctcgtgctgcagctgcatgaagtctgatacaaactcacattggtaggtttcggtccgtttcccgtccacgtacacgtccacatcgttggtcttccggtggactaccagttttacacggggaccgaaggtgcaggtcatggtatgctcacactcttcaaaggtcgtttcacagttggggatgaatccgccgtcagtcagcttgccgcctcgtttcagggcgagggtgcggatccggcgggcttggtcgctgtcacggacaaaattcagtgcctgccacacagcctggcggctgcacttaaaggtcttcatcaggaaggtctttgtctcgttatctgtcaaaatctgctttctcatatcgtttatctcttgatttattgctatatttggcgaaaatttaaattgtaaacaccatggttccatacgtattactcaaaatggatatccttgcggagaatccggaaattaccgaagaagcatttcacgaagcagttgatccttgtctaaaccgccttcggcatttgaagggtagctttgaccgcaatacggacataaccactgcccttcgtcgttccgcacaagatggtggacatgaacactatgtaatgcgtgtagtcctgggtatttccgtaggcatggctcgtgcagaacatcttctgcaggtttatgatgcttacgcaaatctgattgcgtttgaacttccggagtacaaggtgcaggctgcaggtgagattctgaaatttcagaattctcccaagtgacaccgctgcctgttttctttttctctgcgcaggagtagatggccatcctcttttcccggctcaggcattccatcgggatgctgtacacgaagacgggacgttctcccttttcaccggttcggtatccgtactttagggtacctatcgcaaattgatgatacaacgcatcacccaggatgcttttcaaattctctatactgatagtcgcgtattgatcgtttaaaatatatcctttcatatcgcttgctttttagtcgttattgctcatttataattcctcaatcgctttccgcttgatgtcatccgaatcatccggaagtatctcgtaaaggcgtgttccctttttcagttcctcaatcagcacctgcatggcttcttcgcacgcacagctcacattctctatcacccggtaggcatccgagttactgatcgcatcctctgtcatgaactgtccggccaaatccatagcctggtcggcaatgttctgtgtatgggccgcactgcttatcatcgtgcgaagcttctgcttgaactggcgttcagctctcccttgattgaaattctttgccataatctaaattttagaggttaatatcgtggggcgcgggaaatcgaaccccgacggctttctacgctttcttatttcgctttctcattttcgatttaccaactttccggccgtgcctgccgcccctgcccgtctttccgggctgccagttatccggcaatctatttgccttgttcttctatcatcgaaaggacaaccttcctgtcttcatcccaaagcggaagccccaattcgatggttcgtttcaccacttccacctcaccggccagccttaccgcttctttgcggaaatcggtatcgtcatacgcatgtgccttgccaatcagaaagtcggcaaggtcgctgttacgttgccgcatggactcctttaggttggcgtttgtgtcctccaacacccctaagcgaatgccgatttcttggagcgaccgccggattcctccgctcgttgggtcgttcatctctttaaactccttgcagaagtcatccttatacatatctgtggccatataaagccgttctataatggcaaatgtttctgcatttaccgcgcattgggttctttcctcaaattcttgctgtgtcataatctcacttattttattgtattattctgcatcttcaattttgaaagaaaagcacttatccgccaatactttttttacaaagtctaagtcgtatctatcagccgaaaagaaaactgcctgataatctacactgggataagccttgattgctgttgtatccaccatcttcttgaccagcccgtaaagagtttcggcggtctcagctgttgcttgagctataattacttttgctttcatttactttaatccttaaaattcgctaatcacacgccttttttgtatatttggcgcgctgtttacatcttaaacacgctgcaaatatacagtattctgtattacaatccaagcaaataatgataaataattcaattttctgtatcatggaggctaaatacgacatatcaaaaaggtttatcgaagcgtttgagaaccttgtaaaagaaggtaaagttactgataaaaaggattttgcatcaaaaataggcatcagtgcgtctatggtaacggaaatatctaagggaaggagtaatgttggtactttagcaatacagaatattgtatctcaattcaatatatcaggagattggctacttactggtattgggaatatgataaagagcgattctaacagcattcaaacaacaaaagaatcaaccccttctgagctacctgctacttctgatgacgcatctgccgacacacctggcaccgcccatgcacccgaagccgtcgctgtttcaatttcccaaaaagaaaagcagaccatgaagccaatcccgttggtcacggaaaccgcagcagctggttttggcaactgtgactttgccatcgcagaacaggatgtcaaggattactatgtcatcccgaaattccgctacagccgagtcgatttcatgatcgaagtatccggactatccatgcaccctcatttcaatcccggagacatcatagcctgcaccatcctcaccgatcgaaagttccttcagtggaacaagtgccacgtcattgccactcgcgagcaaggcattcttgtcaaacgtcttatgccaagcaagcagaagaactgcctcactgccatatccgacaacaaggactaccctccattcgatattccgctggatgaaatcacaggcatcgcgcttgtggtcggatctgtcagcctcgaataagccttccacactcaggcatcaacatgcagtcgcatttcacgcgatacacgcagccgcctcccaaacacggcgcacgcacactctttggaaggatatttcagactaccagagcctaaaatcactgaaaatcaaaggtttcatgcttatatatataatgtatgccaaaaaataaatgtcgtttttcctatctgaaaacagcgaaaaacggcacttatttacattggcaaccctttttcctatttcgggtgtaccctctaaaaaccgaaaaagtaaccctaaaagtaaccctaaactcattaaagtagtaaccctaaacagtaaccgtaatagtaaccctaaactcaaaattaccacccgtaagggcataaaaaaaggggagccgtaagctccccaatcagcattcaaagaaataacgcctacaagcctttctaacggcgttattatgtcgttctaaccattgcccttactaccgccagaaatgagcgtagattgcttaattatagcctttttcgtgcatattgtgccgttaccagacagaccggcatgaaggaggtaagacttgcttactcccacctgatctgccgtcagaaccgtataaacagccgatatactgctgaaataccaatctttctgcttcgtcccgtctattttatgcagcaaatgcacatgaatcacttttgccatattcgtttctattatgctgcaaatataccaaataatgcttatttggaataattttaaagcatcatatttaaaaataggcacaaaaaaacggccacacagccgttcacaccatcatataacaaaatccatcaacccagccataaaacggccacacagccgaaaataaaacccttccaggccgttttagccccatctgcaagcccgatgtaaagcaatcacccgaagatccgcagaaaagcccatcaaacgtaaagcagatgtaagcccatgtaaaggaaaaaaccgcttcgaaatattcagtctattttcccgaccatacctaaaccctttggttctcaaagcctttcacccattttccccgatcattgaaaaaaccgcttcgttctatgccccatatctgcggccggttctgatatactatcactttctttccggctcccttcatccatcccgcctcggaatgtgccgaagctccgcagggaagtacaagtacacatacatccgcccactgcatggcatcgaaatccgagcggaatcccgcttgtgccaggggatgctccatcgcatccagatagtcctccggattcatattttcccaattttcattgacctgcgaccagtggaagtccgtttttcctgccgggtgacgaaaatcatacacttcgtgtcccctgtagcgcaggaaatttactatgtacggctggtacgggttattccagctgcttgccacatatatttttgccatcgttttcctccttttccttattgtttcatgactttttccttcctcactctttcggttgcctgagcagtatgcggtagttggttttgattgtcacctttaccttccggatattcttgcttgctgccgacttggtcgcgttgatgacgctgttggccgctcccgccacgagctggcttcccatatcaaatcctccggagatattggtattcgcgccgcttattcctgccgcctgggcttcctgtgcggtttccgccttcacattgcccggcacatagattccctggatagcgtcctcggaatagacctgcttttcaaaggggagtatgttcccacttaagttcaccgagacgatttttaccaggacgcgctccccgtcgatgcccgtcacctccccgaatacgggggttcctttgcggatgcgctgcccgtcatcggtcaggcagttctcggccaactgcatcttgagcgtggaaccgaccatgacggtctgtgtggaatgtacgaatgccttgatgacattccgttcttcctgtctcacgagccggaccgtgttgaatcccctgcgggccggtacctggggcacactatccacggctttgcggtgcttgggctgcacttcctcttccttcttttcctgcaggccggtgttttcctttcccctggaagaaaccggttgttgtaccgggaccgtaattcccgctccgagctcccgctcgttatcccggatcagctcctggatacgccggatctccctttcatttccggccgtgtccgcaggctcctccgtaaccgggtcgaaacctgaaagggaagcggatttgcttgtattttccttctcgactttttggagcatgtcatccagcgtaaagctatccttgatccgggttctaaggattacctcacccgtttccggccccttgctcccggagccggacaggctggcgatgaatgcccacaccagcaggacaactacaatccctaagcccgccagtatggctattctgcttttcccgtcccgtgtcataagagttcgtattgctggttataggtacggaagaagaaaccggacgtattttccggaaagcgcggagtggcatggatggcggtaccctcactcacaatccgtactttcctgatgtcatcgccattaataatgctcaggatggaggagaacctgacatggtactcctcaccgtcggcacgtatatcgatgatcttttcaaactccgtcttgtagacaaccccgagttccagcgcatctccataggcgcggtccgcctggtatttggcaaatacggtattcgcgtctggcttgttgaccaggaacagggcacgggcacggttctcctgcagggaaagcctgtcaaagctgttcaggaaataggccgtccggcggcagtgccctcttaggaggctttcgtacagcaggtcctgctgcatggacttgaaatggacgaattcccctccttcattgaccaccaggatcttgttcatcgcattgttcaccacgctgtgtgcgaagaacaggaccatcgcgatggttatcccgcagaaaataaataccagtttggtgcggaacgtatggttctttctggcttccgccaggctggagaaatccttgagtatgctttttactttgagtatgctttttgttgctttcatggaagtttcattgtataatttataaccatttgtttactgtggcctttaccgtgccaagcatcgtgagcttgagcaggaaagaaaaaataaccatcagcagcaccgaccaagatctttgcaggacatagttcgtgacgatcaggtccgagaaaacgctggcaaggataaaccccggatagagcatgtagcatcctaacatctgtttgacccatgtgtagaaggagctgcgcgtgtcattgttgtacaggcaggctatcgctatgggagaaatgatctcgagcagtagcagtatcaggtagcgggtacagaggaacagcagcatgatgtaatcataggccactccgaagagactgcctatcgttcctgagataagtgaccatttcagggtatcgagcccgttgacggctatgtcggtgatgtccccgttcattagttcgtccagcatggcactgatcggatctttccagatattgtgcgggttgtagactcctccgttggcgagtgacttcatcagctcgtcggcgccataggccagtactgtctcgagcgttcctaacaacacgggcatgatacataccaggcctatgcagaagatgtactccctgcccagctcgtagaagtgcttggcattgaatccttttccctcgcttgtcatctccttgaggattcccacgagcttgaagatgaaagtcgttatgacaaatccggcgacaagcgcatagaacccttctatgactaccataccctttatatgcaggtacgcggcgttcagatttccgtatgcttcttccatccccgttatctgaatgcccttttgagccgttcgtactgacttatgatctgggagatcttcgctattttcctttcctcctcgagagtctgtttctctatgttctgcaaggtagacagccgctcggcgtcattcatcttcacgcttgtggagaggatcgtcctggacaactggatcagtcgcctgttaccggccatgatctgttcaacgctgccggtgagtgtcttcagcgtcgaggaattcagttgcttcccgctgaccaggtcaacgcatttttgggagagccttgcctggcgctcgataatataccgggtcgtctcacagtccgacactacggagttgaccttgcgcatcaggtccaggctttcgtccagcttgttcttctgttccttgaggtagcctacctgtttttgcagctccttgaagtttttaaggttctggcttaaattgccggcatccgtcacggcccattgtgctgatgcggtggctgccgccatcagcacgattaaggataaaaataatttcttcatacggttcttgttttaatgttcgtttatatattcttcaatagcttcctgcatggacttgccgcttccggttttgtcctcaaggtcggaccagatctcgccttccgtctggaaagcaagaaacttctccctggaaaactccaggcgggtaaccgtcgcgtaattctcacccatgcgcatgaagcattccgagtagggacgggaggcggcgaagttgttccgcatggatttcatcagggctatctggccgggctgcgtcagcttgaacttgtcgatgatgctctggtagataacctccttggtcggcaatacgaacagcatgtccgtgttgctgatgatgtttttcgtgttctcgtcatcgggcagctggtcaggggtctggacaatggtatatacggctccgttctctttccgtatcttctggtagcagaaggccacggaactgtgtatgccgctgcctgtggccgtatccaccatctgcgcggtttcggcatactcgtcgaaaatcagtatgccgcgctttctcctgtcactgagcagctttttctggatgacggtgaatatcatgctcatgaccaggtttgaaaggaacctgtcctgcttgatccgcgtaagctcgaacacgatgaacttctttccggagaaatcgatcttcatatccttgcagacattctcgtaccgctgcccgggcatgaattccccgcagttcagcttgaaagactcaatggtgaaatacgtgccggggatatgttttctctccaggatctcatcgtaattgtctatgacgtaattatagaaactctcaaagttatgcccttgccggacatgttcgtaatagtcctggataaaccgtgtcagggcgacttccttctccgactcgtccttggtgaacatgtgcttccagtatcgctgtacgatgccggagagcgtttccaggtcattattgtccagttcccctccctgcaggtcaaacgggttgatccccaggggagtcttgccgtcatagtccacatgcagggagatatccggatagagcttgcacagctggctgaatgaatttccgaactccacgacgatggtcgtatagtcctgctcgatcagctgctgcgtgaaattcagggtgaaggctgattttcccccgcccgtgccggcaatgaccatcccgtttcgggcattcaccctttttttcgccgcgtcccagatatcctttcgcaggggcacctggtacatcctgtcatgtacgtagatcccttcggcgtcattgctgaacttgctgcactggagaaagaaacagagcgctatgggcagggtggtgaggaaaagatattccaccggcatcaggctgatctgtccggggacacaggcgaagtgcatccttgccaggttcccgtagcccggtatataatatttgaaccggttcaggttcaatatttccctgatccttttgtcagccttctccagttcggtatccgacccgtcgaagacacagaccgaaaagaaggagcgcaccagcatctggttctcctcgaggatctctgtctggagcttctccagctctttaaattctctttcgatgcccttgttcatggaagagttgctcccgtaaatgtctatgttgcgtgcgatccgggagcgcagcctctcgtttccctcgaaatagatgacctggttgacgatgtggttatagggaaggtacatgcccagctgctccatcaggggatggtacagttgcgaggcggccggcggcagcgactcgtccctgacatgggactcgatgtttccttccgggaggaaggtctcgtcgcacaccgcatagcagcgcgcatggttctttcccacatgcaggctcccgtcgacgtgtatatccaccacggcctccgtatcagcgaacaggcaggagtatgcgcgggtgaatccggatatcccttcacgggacatgggcagcaccgagttcccgcgcatgttctgcaggatgctcaccgcattgtccaccccttcgagaaaggcttccagctttctgtagtcttccctgtgcagatgttccttataggccaggggtgaggatacatacgccttctccaggcttttcagccctgcaagtacaaagtgcaggatacaggtgtggtcgatgtacaggcgtccttcaaagtggcgcgcgtcggcgcggtccaggaaagagccggtgcctttgcccgggtggtactcttttttaaggaacacgtcctgtttgtgtacgtaggtaccgtcgggcatgtgcctgaaggcttcccggtacatcccgtccctttcgtcgatctcttccggagaaagggaatagcactccggctgccggagctcgaacgggatacatatgctgccgctccgggtcaggatcacactttgtccttcagactcgctgataatgtcaagtatgctgtatgcttcttcttctttcatcttgtttcttcttcagaagttgtctgtttatggttaagttactcacggttatgccgtactttgattccctgaatttcgttggccgtgcctttttcctgaaccggtacgccagtgccggcagcagtggcagcgataccagaagcaccaatagtgtcagggtccagtcaccggtcatgatgcctgtgcggacactcaggaaaagcaggacaagcgcggcggcacaacatcccacaaaaatccagtagtccgatgaaaggaagccccgtatcatgcaggggctttccagtcctttcctgacagtgtacctcatacggtcagtttaatgccggatagcgcggctttggccgctgttatcacgactcccgcaagcagggagaaccccacataccagcccagggcaaacaggccgtccctgcgtgttccccggttctccttgtcgatgatgttatccaactgctggaccacccctaaggcaagccccacaagcatacaggccaaaaaaatcggcagggtgtaaccgtccaggatctggttcatcgcgccgcgggcatcctgtgcatatccgcgtagggtggacgcaaataaaaaagcggacagtagaaattttcttttcatgatggttgcttattttagggttgtatggttccggtatagtctcctcccgtttcccagggacgggcactcacaccggagagcatgagcaccccttctttgctcagggtcaacgcgtaatcgtatcttttaccggcttcaaaggtgtttgccggaagataccagtcataggtccggtccaggtagcggatctgcgctttcctctcttcaagcctgcctggcaggagcagcaggatgttctccttggaagaaacggtgccgcttccctgttttacggacaatgtaccgcctgtaaggtcgtatgtggcctctgtcggtacggcttccacattcaggctgcacgcccggctcccgtccacggtaaaggccagaagggagagcaggtgcttcatttcgatactcgcccggcggttctgccagtccagacgcacttcatccgatgccaggtaatccgtctggggactcaggctgacagccacttcctttcccgggatactccggaacggggagaaagcgaacagccggcaggtttgctgggtaagcgtcacctgcggaaaattccagctctccccataggtcacatgcaacggattgctgacaccggtatatgatccgcccgtttcatcgagcagcaccatgccgaagtcctttaccggaacatggcccgtatccgcagcggaactgcggctgaaacagttttctatctcaagtcccgcctcttctgtcccggggaaggagtcttccttgccggagcagcccgtaagggccgccggcaaaagaaacatgactatgtgtttatacacttttattttcattttttgctattcgtttaattaaggattgatatcaattgaagttttacccttctgtctgacggtcagtgtcagtgtctttccgctttctgcctgtgtaagggtcacgcttccgctgcggagattcttggtcggattctcgtcataggtcaccgaagtgccgttcacgtggatccagccggtgtcacccgatgggctccaggagagctctttgacactgtttcctatggtcttgcggctcgttatgcttagcaggaatgaaccggatcccgattccgtacgctcactgtgggtcactgttccgtccgaatactcgaagacatagctgaccggaggggcttcctggctgatggtggccgtagcggaactaccgccatgacttgccgtaaatacgcagctgcgcgcggatgccgtattgttctccgatacgttcaccgtgttccctgaaaggaaaaatccttccgtacctccactgatagagggcgaacctccctggagagtctctttaaccccattgacgaacacctcacgtgaggcgcccgcactgagcgtcgaagtcccccctttccaggaaatggcggaaggattggccgtcagggtaactctccaggatccgtaattccggtatttaggctcgagggtacggtccgcaagcacctcaaagctgtattgtgcggtaccggatacgatccttcccccttcataccagccggcaaactcatagcccggcttcacgcttgccgacaccgtacagttgcttcccgtattgtacagtcccgcacctgtggtggttcctccgggtgcataatccaggatggtgatctgcttcttgtagtccatccggtaattatggatctccccctcccgggtgaccatgtcggaagtcccgcggagcttgatgccggtggttcccgtaagggacacatagttggaggaggtcgtaagcctttgtgcggggatggttacccggaacactgtggttcctcccgcctccgagtatttgtacatcgcacagttccccttgctttcgtccgtgctgatttctccggtaagaagattgaaacggcttgtacgtttcacattctccatcgtggcttccctcacgccgtcatttctctcgatcctgacctctacggtcgacatcctgtgtttgaaattcagcgggaccgtgtagtcccggataggatcggtataggtcgctgtcatgaagtccgctgaaatccagcccgccttttcgttctggttgccggcggtatgggaaatcccggttatatcggtctgccctgtcttgaaagggtaatacacataaaaatcaaagtcggttcctaccgttactatgatattgtccgcttccgcctccggcttgaacttctgaccgtcatacgtatacttgttgttcaccgcccaatacacgccggtcttcggttcgatggcgaatacgcctatggcgtcgcctgtctcgaaactgccttcctggctgcttcgcgtttccccttgttccgtcatggcggtaaatgtcacaagccccttgtccggcatggcttcctccggaccggtatcttcccggctgcaggaaaaggataacagaagcaggaaactgcagacaatcgttgttattgctcttaccattattctctttttattatttgaccggaacaagggtgatgtcttcttcagtggaagtccagccttctatggttaccgactgtccgttttcccctccgatctccgcatcgttggaacgcatggtgatcgagtagatgtatctctttcccgcctcccaggtgatttgcgggatggcataggtataggtcgcaccgtcgatcaccacttcaagcgacacctcgcccgcggccagcgccatcgggtagatggccgcggcataatccaccgcctgctgtccctgtgccggaacggtcgtgttcgggctccaggtcagctccgtgctggtaggttggaacgtaatttttcccccgtcgttcaggttcatggttccggtagtggcgaacttggaggccgttgccttgagtttggccgaggtcaggtttccgtcgttatggtactcgggtgaaactttcagccgcaccacaaactgtgaaagcgcatgcttcatcggtattctggcatcggtctcgatcacggatacctggttagtgcttttgccccacatgtaatcaacggacgtgccgtcattgataggaaccggtattttggtaccgtccgtcacggcctggttatacggataataggcccatatggtggccttgtctaccagcaggtacaccgggctggcctgtgaccagccgttcgcctgcctggtcgacttgttgttctgggcatcataacgcgggtaggcgtctccccagccgctggacttgtacatgaacaggcccagcgcgtcgcctgccgcccaatctgtcttgggatcgaaaccggcccttgtttcggtgctttcggaacttacggtaggtacgatattcagctgtgcccccgaatgctcgccgtccgtcacttgcccattaaaaatttcttcactgttgctgcatgaagccagcaggcctgcggccattaccgctgaaagaaaaaaacttgttttcattttcatctgaaaaaaataaataattaattatagtttggtaattctgtttccgggatatcctcccaatccggaatgacaaccggttctcctatggtcagttccttgccgatgtgcaggtccagttccagagaaagttcatcgctgtcaaatccccggagatacggggtcaggtccaccttctgctcttcgttgaataccgaatccttcccgtccatttcaatctttaccgaaaggatattctccgctgcggggttgaacccgaaagcgtacaggcttgtcttccaccggtcggtttccggtttacgcgagaacaggcttgtgacacttgcgtttcctgtcctttcccgggagacaaggtaccggccggtggaaataccggtgagggtaccttgcaggccggccaggggagtgatattacccgagacgttgatctggatattcagccgttggacgaatgcggacggtgttatgggaacgcgcttgggcctctggtactccaggcgctggctgaaaccggccgaacagcagaacttctgcacgccggaaatgtatacctcgccctccagggtatctgtccgtgccataaggcgggcctcgtgataatcccggatgtcgctcacttcataattcccggtataaaataggaattggtattcaccttgtggaatgctttggcgcagggtatcctgcgtaaatgtcatctgttccccggaaggaatatccataccggaagggaatgctatgatgtgcctttcctccggtacgggaggtgtttcccggatcccgctgaaatcacaccaggcgaccagctccccgttcctgatacagaaatcctcgttgaactcgcagccgctgagaacggccgcaaggactgtaaaagatatgaatctgttagtatagttcatctttatataaattataagttactatcagtttgttgatctccggatcgagcttgcccctccagatcttggagtcatcctggtcacaggacctgacatacatcttcagggcttctttctcccgtcccagacggctgtagaggatagagagcaggtagttcctgtcagaggtatccggctgtttgagcatgacatccagggcacggctgtcatagcctaaggacatcaggcagaccgccgtattgtagtcctccccgtagaactcttccagcatggacagcgcctgcttgtattgcctgttctcgatcaggctgaccgcgtgcatgtaggtactgtcgatgaccggcatcacaatcgtatcctggatcatatcccggcggtggaggtggaaattgaattccacacagcgcagcagcggataatacctttcccggatgcgtttgtagtcggaagcatattcgcgcagggcatgttcccggctgtcgggattcttcgtctctttcaggatacgtaaaatgccggccttgtttgccaggctgtcatctgaaaggaccagttcgtgcagcctgctccaatcctcaccggtccagcgcgggcggaaaagcgtatcgaccccttcccggtcttccgtgcgtgcggcaaggtatttcttcagtgccagcgcacgttccctggaaagggaaaggttcatttcggagccgccctcgggggacgaagtggccgtcatgcggatgctgtctatgaggaactctcccgtataattgattccacggatggtctcgaacaccttgtcgatctccgccttgttgttcccggtcttttcatcgaacccggtgctgccggtcttataggtcacataggcccgcaggctgacttcatccttgcgggtgatgatcttcttcctgtaacgcggcgtgcggtcgaggaactgcaccatgctggagatataataggtgatcgtgtccgatggcggaagctgggtccgtacctcgtccctggagaggatctgtccgtcaagcgtcagctctatcttcttcgtgttttcggtggcgggaagttcctgcttgtaataatacacgaagctgttgccttgcctgatgaccgtatccaggcgtgcgggctcataaggaaaccgcacatacttttcgtacatcgcaccggcctgctcctttcttttctggttctcggctatcttcttgtaatcggtaaagcgttccgttatggccgccgaatcttccggggtgatgcttctcgtgcggattttataattaccttcggcaaacatcttccatttggaaggaatgtatttgccgtctatttcccggcgcatccaataggcgggaaggtactccaggatggaattgtatccggcaatggcctgccggttacgttccatcttgtagttgaacagtgcgaaccgggcattggtcttgtctgaccagtcgacccagcgctccttggcgatgacctcgtgcttccaggcctggaagtattcctcctccagctcggccagtgccttcttgtagcctttgctgtcgagcagccgctgcatatacaggctgtccgggatgatggagttcatgaacgcccggtagcgcatgtaccctttctcctgcattttggcaaagtcggcccctgaaaggaagatcttgtccaggtacagggtgtcggacggtttataggctacgggagtgagctggacctgccacttgttgttgatcagctcaccggggaccgttacgagaaagtccaggttgatctttccgtttctctcggctacctgtttgctttttgccatgacagtaacttccgagagttcgataagggtcatattttcgcccgtgacactgtcatgggatacctgtttgaccaggtgttcttcacctttgtcatccgtccaggcaatttgaccgggcagctgtttgccggtatccgcaaccgtctccttcatctgcggctgagagatacgtacgcgtgccagacggcgctctgtggtgcatgaaatcagtaatccgcagaaaacaaaaggtatgatacgtctcgtctttctcattttcttaaaagttagaacaggtacaccagattcaccgctgcccgggtgggaaggaaatgccagccataatttttggatacaaggtcgccgcagcgcttacacaggtacttgtcatggcccagccataccgcgccggcgccgatttcccactcaacgttccagcgcgtactgagctggtaggctttgcctatgctcacgcccacaccgtagccttcaccttcatagcggtacctgctgccgaagaggttgcccacactgtatgtaccggcggtgccgtgcatgccgataaatggccccatatagctctcgagcagccagtagcgtacacccggagcgacatataggttacggaactgccggttcctgctgaagcggaacgggttatactgcacgggcaggtgaagtgaccatttacggcccagggtcatggatgcctccaggttcaggttggtcgtagccagacccaggacgttggtacgcagggaataggactgggccgatacccctaaggcaaaggcaagcaggcttcccaaaagaaatgatctctttttcatgccggctgttcctccttttgcttaatgacagtcacttcccaggctgtcagcgtattgaaccagcggttctcccactggcgggcggagatgtcaaaccgtacgtgtacggtcatacctacctcgacggcgtaccgctcgatgttggcgttcatcagctgcaggcatacgctctgcggtttgctctcttctgtctccagaacgaattcccggcttttccattcattgccggaagtcttgccgatcccgtccttgacgggaagtacggcgatgatttttcctcgtatttccatttttatcaatattgggtttttaatgctctgtttattttcgcactccctccggcaggctgtcacagcttaccgcagggctgcgaaaaggaaaggatacaccctgactgttttatttgagatgaaagaatgaatgtgtcactttaaacaggggtatcctgattctatatattactggtttttagatcgctgttttatatttggccggcacgcctattctttccatacggccagaaaacgcctgtaccgttcccgggccctgacttcgtcgataacctccatttctataaccttgcaaccctctgacctttctccggtctctttatgaaaggaaccgcaggaaattgtcgggatacttagcgggtagaaataggtttcgaagctctcctgcctgttcaggaaccggtcggatagcaatacatattcaagagattctctttaccgtgcatgaccttcccgaattgcccgattatcagcttgtcgggagaatatggaatgtagtcggcctttccggcttcttcatttagttcggcatacaggtcagccttaagatcatccggcggaagatcctcttttttatcgggcatgaccgcacctgtcctgtccccgattggcttgcctattgctgtcgcgggctttctgcgggctcttatccgcatatatataatgtagggcagaacgacagccaaaccacccagacagccccaaaatacactgttcagaatattcatatacttcttgtttagagggttatttcacatttgttattaaccatgccatgcttctttcatctgctgtttttgaactatacggtaaatggaaatctgccacatagttggtctgttatttatttctcgacgcttctaaaaccggaagattggtctccgttggtatgtatatcactgttttatcatttaaattgctttgctgacgtacccataaatattggatatatgcaggggtaatactcccattctctattctgatggcttctgcggcacctttggcacgttcaacttcggcctgggcattcaacttttctgcttccagattagctttcgcctcttcaatcttaatcttacggttctgctctgcttttgcaaactctgctttacccgacatttcctgttgccacacattgtaataagggacaataaaaagacctcccgtcatcatcgcagccaccaggatgactgtcacaattcctaatttattcatataatgttcatgtaggttttataaagccgcccaaggctgtttgtaagtattcgataaactccccctttcattctaaaaatgtgatgttacttttgtactttggagcgatgctgcagccgcggcttccgccggcggcagcttgtactgcccccactcgtccggtattgcttccgtatcgaacacgccgtaaggctgcgaaccgtcctccggcatcgccacttcgagcgtaacctctatcttggaggtttctgtaagggtcagcttgcctgcaggattggaaagcagcgtggcgttgggaatcagtacgctctgtccggacacgagggagagttcccatggtccctgcatgacaagcacctccgacggggctgtccagccgatcggagttttcttttccgagtcttctttcttataatgcaggctgccgccaagcagtttgtgcaggttcgaatagttcatctggatcacattgaacgtcggggcgatgccgccgttactctgtgggatgaccagcaccggggcgccctgcacctgttcagcctcgatcttcgcggcctcgggtttcttgccgcccaggtcaaacgagtttttttcaatatacccgattgtgaaatccttatactttacggctcctatgccgtacatgaaattcttgttcatcgtttataaagtttgatggttaataacacaccggccaataagccggccaatacacctgtgataaacgtccgcatccggttcggagggcgtttttctactgtttgaacgtcatttgaaatttcgctcttggtttcgctacggatgcgcgccagctcttcttcataccatagcaccagctgctgcagactgtcacacgaggcttcggccacgatgttcccgctgtcgtcgctgcctacggtcagattcgcctgtccactcttgccacggtacacggcaccttcaggaagtttacggaggctgtccgcaggtatagacagcttcaccgaactcgccggtatacccgccatcaccagtcccgcccgtcggcttccgctcgcgctgtcggtgcttgccgattccgtctgtatcttctccaccgtcgtgctcttcctgctgcttgcgcagcccgccaagcacaggacagtcatcatgatggcggcaactgttggcagtgtcaatggccttgcgcagtcgcgccatttcgcgcttgttggcctgcaggtcttttcttgttgcattcagttcttcttttaagggtaccacaatattgctcaccaaaacgcgggtggcatgttctgcgttatccacacgcacaccctctgcgtcggcttcggctttcatcgcttccgctttcgctttcctcaccgtagcacgcagggaaccgatggctgctgcagtgcccacaaggccgccgctaagaataatgttcatgatctcgctaaagtccataccacccgttttttagtcagtcaaccttttattctgcgtcctcgcgtttctttcggaatagtccgataacccattgcaccagtcccgtgtcggctaccccattggctacaagtgaggcaccaaaaccatagagcaaggcaatgtcccagctcacatcactcacaaatccggcatcaagccaccacagtagcatcgcgcacaccaagcccacacaccagctcaccagctgcgtcacccagcctttcatgttggggaacaaacctttcaacccttcagtaagcaccaccacaccgccgacgaaaccggcaaaggtgccaatcattgcgtcatagtccgttgccggaacatcggccccttgggccatcacagccgatactgttcccagcatcagcatcataaacagcataattcgtttcattgattgcttcttttattattggttaatacctatttctttcagccatttctgtacatcgaaactggggcaggctttggccgccagctcgttgtgtcccacaatgcgcacatccgggaatctgcgatggaagtccttcacatacttctccagtgcctttttctggcagccggtgcgggtgtccttcggggtcttgccgtccttggccacaccgccggcatacacaatgtggcggctcacgctgttgtaccccttggctccgttggtcacttcccagggatccacctgcgcatcctcgttgttgttcaccaggcgttccactccgccgttcagatggaacaggtcggtatatccgacctgcttccagccgcggccgccctttgagacggggttcgtatgccaggcgcgaatctccgcaccgcttacctcacgcccttcaggagtggccgtgcaatggatgacaagatacttcagctttcccatcactcaccgccttcctcttcatcaacggccgcctgggacagtgctatctccaccttcttctccggatcggcgtccaggcccagtacaagtgtgccggataccgccttgccgctactgttcacaccggcggtgaccgtcagagagccatcggtaccgactgccgtgaaaccggcaggaatggaaaccacgctgtaatcaccggaggcagtgaccttcacctccttgctctcaccggcggccttgaaagaaagagcggccggatcggcagaaatgctgcgttccactaccttgaacaccggagtctcacgggtgtcaagcaccacgaactcctcgccgaaggcgatttccgtgtcggccttcataagcagcttgaagaagtacagctcgctggagttcatccacttgtcaatctggatcacctcctcatcgtcctggaggttcacaccggcaaaaaggttgccgtcagcgctcatcgagcagagcgtggctacgataaggccatcaggccaggaattcagcgtctcgatggtgatacccttgtaacgcttcttgttgatgtccgtctcgctcgtgttcttgtactcgcgttcggtcagctcgtcatcgtacttgtcgaagtcgtcaatactcatcaggatacgcaggttcggattctcacgcagggcttttggaatagccttgcggacagccttcaacttgccgatcatggaagtatcggaaggagccggaaccacgatcacatccggatctttagccgcctgggtcaggataccgttgaaaaggtggtcgtcgtccgaaccgaactcgccgttcaggtaatgccagcccagctcgaacttcacactcttgctaagttcatccagaagcgtgttctgcgcttcggggggaagttcggcaaacacgaggttgcccttcggctgccacttgcgccaaacatgctcgaaggcacggggattgaaagtcgtgaacgccatgaagtcctccggatccagtgatttctccgagtaattgaaattgcctttcgagtcttccaaagtcgggttctccttacgcttctggagcatcttgcccgtcttgatacgcggcaggctgatttttttctccacaccggggatcaccatgatcagacctttttctacaaggtcattcccggtggtggccaggaccagtattttctccagtacctcgccgttgtaattcgtgtttcttactactattgccatggcaaatgtttttatttatggttcaacttgtccttaatctcgctcatgcgcttgttccaggggctttcacccgtcggattcacacgaaggtcggtcatgacactacgtttgggggaaagcttctccaatgccttttccccgttctcccggtcttttgccagaaggttctcatagatggggcgggtggcggcatcgatacggccgtcctgttccgcatcatcaagcagtttcttacgcgcggcagcgtcatccgcatccgccttgtcctggaacaccttcagttcgcccttcaggcgggtgacctcggcatcaagggccgggactttgccagcctccgtttccagcagtccgatttcacgcaggaaatcgtcatccgtcgcacagttcttgaaccgcggacgtctcttgagttcgtctaaattcatgctattctcgttttgtggcttgtgcagccggttattgaatatttgaaatacttgttcgggggtactgtcctccggtaccgggtcagcgtcataaataccgtcgataagccccagcgccagcgcctcgtcggcacgcagccagtgatccttgccgtcaaaatacatcgcgcggatttcctccttgtccttgcccatacgggtggcatacatctcgcaaagggtatcctcaagcgcctcgatctcacggatgcagtccttcatctcatccttgttgccgtaacagccgccctggacactgtgaagcatcagacgggcataacggctcatctgcacgggcttgccgcaaagggcgatgacggaggccatgctggcggcgatgccgtctacgtagatggtaatgtcggccttgctgttcttcaaggcattgaaaatggcgatgcccgaataaacctcgccgccgttgctgttgatacgcacgtccaccttcccggtcagggcttccgcttccagaagttcacgggcaatatcaccgctgcgcacgttatcatcgtactcaccgatgtcaccgtaaagaaggatgcaacaggcatcggttccgggtatcatattgaaaaatctactcatgtcactatcgttttggcaggtccttccctgcaaagtttacggtgcgaaattagggggattaaaagcctttttcaaaccgcgttttcatcatggagactttaaaggattgccatgacgctttaaaatgtcatcatgcggagcgcgttttttttcgctccttttccttatcaattttgcacgtaaaaaaggaggtaatatggccgaacttacaaacgagcagaaaaaggcatgggcgaaaacgctctacacccgcgaaacgctcacgcaggcggaaatagccgagcgtgtgggggtttcacgggtgactgtgaacaactggataggcaaaggaaactgggagcagctgaaggcttccataaccatcacacgggaggagcagctgaagaacctgtaccggcagctggcggaactcaacaacgccatcatgggaaagccggaaggggaacggttcccgaacgccgcggaagcggacaccatttccaaactgtcgaacgccatcaagaaactggaaacagaagtggggctggcggacatcatctccgtgttctccgacctgctcaaatgggtgcggacctacgattccacgcaggcgaaggagatcaccccgcttctggacgcgtttgtcaaatcaaaattatcctgacatggcaaagaaaagactcacaccccaggacaggatcgcactggacaactggaacgagctggtggcatccgtgcgcgaacattcggacatcaaccccacggacacggaaacggaaatcaggcagaggcgggaaagactggagaagaacgacgaggagtggttcaaatactacttcgccatgtattgcacctgcgagtccgccgccttccacaaaaaagccaccgggcggctgatgaggaacaaccgctggtacgaggtaagggcctggtcacgcgagctggcgaaatccgcacgctccatgatggagatatccaaactggcactgacaaaaaagatacgcaacgtgctgctgatctccaactcggcagacaatgcggaaaggctactgctgccgttcatggcgaacttcgaggagaaccagcggatcatacaggactacggacagcagaaaaaaccgggagcgtgggaaaccggggagttcacctgcatgtccggatgctccttccgcgccatcggagccgggcagtcaccgcgcggtacgcgtaacaagaacttccggccggacttcattctggtggacgatatagacaccgacgaggagtgccggaatccggaacggatcaaaaccaaatggaaatggctggaggaggcgctgataccgaccatgtccgtatcgggaaactaccgcatcctgttcaacgggaacatcatcgcgccggactgctgcatcaaaagggccatcgaaaaggcaaccgaactgaaggcgaaaggaatcgggcacgtggatatcatcaacatccggggaaaggacgggctgtccgtatggcccgaaaagaactccgaggaggatatagacctcttcctctcactggtcagcgcggcggcggcacagaaagagttcttcaacaacccggtggtggacggcggcgtgttcgcggaaatcacctacgggaaagtgccggcactttccaagttcaagttcctggtgatatacggggaccccgcaccgggagagaacaagacgaaaaaaagttccaccaaaacggcgtgcctgctcgggaaactcgcgggaaggctttatctgataaaaacgttcctggacagggggctgaacgcggaatttgtagagtggtacatcaagctgctggagttcgtgggcgggaaaaccaccgtatactgttacatggagaacaacaaattacaggatccttttttccagcaggtattccagcccatcgtgcggcggatacgcagggaaaggaaaatatcactgtacatcgccggggacgaggagaagaagaccgacaaggccacacgtatcgaggcgaacctggaaccgctcaaccgggaggggaacctggtactcaacgaggccgaaaaggacaacccgcacatgaaacggatggcggaacagttcaagctgttcaacctgcaactgacctatccggcagacggacccgactgcgtggaggggggaaacagaattatagaccgcaaggccagacagtcggaaaagcccgtcattgtcacaaggaaaagcacgcggtcacaaaacaagtacagagtgtaaacttcaatacctatcattatgagcaaatttatcgaactttcagactacgacgcgagcatacaccgcgagattctggacgcactgacaagggaggacgacgccgtcgtggagatatgcgaggaccgcgccgtcgccgagatgcgctgctacctttccagacgttacgactgtgacaaaatattcacggcaaccggtgacaaacgcaaccagcttgtcctgatgatggccatcgacatagccgtgtaccacatcttctgcatacataacccgaggaacctgtcaccgctgcggaaggaacgccacgaaagggcggtcgaatggctgaaagccgtggcggccgaggagatatcggtggacggcctgcccctgctgtccgaagagacgagggcggcaaaatcaaatttccttatcaaaagcaaccgtaaacgtgtaaaccattggtaatatgaacaaaagaaagaaaggggccggaaagataacccaaagcgggaacctgccgaggcccgggcagaaaggacccgcaaccatcatactgacacagcccagaaggttcggtatagacatagcggactacatgctcgcggtaagggctttcgagaatgtggactactccagacgcttcaggctgtacgacctgttcagcgacatactcatggacacgcacctgacaagtgtcatagagaaacggaagaatgccgcactggcatcttccatagaattccgcaggaacgggaagccggacgagaaggtgaacaagcagatcaggtccccatggttccggaagttcataggggacatcctggacgccaaattctgggggttctcactcgtgcagttctaccgcaagggggaatgggtgaactacgacctgataccgcgcaaacacgtcgatcccgtgcgcaggctcatactgcggcaccagacggacaccaccgggacgtcctgggacgagtaccccgacctgttgttcatcggttcacccgacgatcccggactgctggtgaaagcagccatctgggtgatatacaaacgtaacgacgtggcggactgggcacagttcgcggaagtgttcggagcgcccatcagggagtacacgtatcccacggatgacgacgaggcacggcagagggcgctggacgacgcggacagcaccggaagcctgtcggttttcgtgcacgcggaggatacggtgctcaagctcgtggaagccgcgaacaagacagggagcgcggacctctacgacaagctctgcgagcgctgcaacaacgaaatctcaaagctgttcctcggaaacacgctcaccaccgaagcctccgacaagggcacacaggcactgggaaccgtacacaaggacgtggaggagaaagtgacgctctccgacaggcaggacatcctcgacgtgctcaactatgacatggccgacatattcgcaatgctcggaatagacaccacaggcggggagttctgctatccggaaaagaagcttatcgaaccggagaaaaagatgtccatcctcacacagctgcgtacgaacttcaacctgccggtaggtgacgactacctctacgaggaattcgggatcgagaaaccggcaaactatgacgagctgaagaaacgccaggaggagaaagcggcggaaatcgaggcagcgaaggcccgagagaccgaaaaggcggaagaggatgaaccggatccggaagaagaaccggaactggaaaagcacggtaaaggaacacccaaagaaaagaaaaatgcccttaaaaacgcatacaactggctgaaacgttttttcgggaaagccccggggagagacggggcagctttagaatggtgataaacgacctctacagaatggaggacaaacaggtggaaactttattctcgttcgatgaagaggtactgaagaaagccctgaagaacatatacagcaaagatttccatcccatgaccgacatcgaggagaacctgttcgaggccacgtggaaaacgatgaacaaagccaccgacaaggggtttgggacacggaaaaccgatgatccggattatgacttctaccgtgaaatccgaatgaacaacgccgtgttcgcagctttcaaggtacacagggcacagaacgacatggcagcgctgctgctggacaaaaacggaagtttaaagccgtttgaacagtgggtgaaggaagccatgcccatagccgaccaccagatgatccattggctgcgtacagaatacgacacggccgtcatacgggcacaccaggccgcggactggagacagttcgaaagggaaaaggatgtattgccgaacctcaaatggatgccgtccacaagtgtgacgccgggagccgaccaccagattttctgggggaccatacgtccgatagatgatccgttctggaacgagcacaggcccggagacagatggaactgcaagtgcacgctctcatcaacggatgaagcgccgacagcggtaccggacgaaaacgggcagaacaaggcacatgacggtctggaaaacaatccgggaaaagacggcaaactgttttcagacaaacacccctacattactgaagcgcatccgggagcaaaaaaagccgtggacgcactgaccaggcgcatcaacgaaatgatagccgaaatgccggacaacctgacgctggaggaaaaaaccgacatcgcccgcaacaatctcaagatagaaaaggcactcggcgttaccaaaggcaagccgatgacatacgaacaggcgaacaagggaaaggagaacccgaaattcggaaaagaggaaggataccgcgtgaattgccagacctgcaccgtgacacacatgctcagaaggttggggtttgacatcgaggcaaaacccaacatcagacaaagcgcatacaatgaaatggcaaaacaaggtatcacatgggaagaacgtttcctgaaccgggacggaacaaagccggattatgactatacctataaatggcaggtcagaaagggatatcaagtaatgaatgcaaaccggctgaaggaatacttcagggaaaaattcagagaggatggaatatacgagatatattgtgcctggaaaggcggctccgcacacgtgttctgcgcagaggtgactgaaggaaagacaaggttcttcgacccgcaaaccggaaaggatgatgcaagcaattacatacagagcatgaaagcgggccgtgtgggagtgataagaatagacaacaaactggtaaatcccaaaatcatgggactattcatcaccaaataaacgggaagaaagtgccagcccctcctcaccgtccaccagacggcaggactggccgtcgaacagaataaaggcgggaagaccgacaggcaactcaaaaccatccccgtcaacacagcccacggaatagatgcttccttcaggggaactggctgataagacaacggagttgtaaccgctactgtttgctaattccgacacttgtttaggtatttccataacgcaaaaaggcacataaaaaacgccttgctgcaaaagtataaaattattttttaattcagtcattcatggacataaaagaatattcaaaactgataaaagccaaacggaaagaactggatgggctaatgaaacggaaaatgccggttatcgctggacgaatggcaaaagaccatttccaggacaacttccgccgggaaggtttcgtaaacggaggattacacccgtggccgaaagcgaaaaggctgtcctcgggacggaccgatgcggcagggagctacgggacgctgctctccggaaggaaccatctcttcagctccgtcaaatacatgccgggagaataccgagtgagggtggcaaacgaactcgtctatgcgccggtcaataactggggaggagaagttcatccgactgttacgccccaaatgcggcgttttgcatgggcgaagtattaccaggcttcaggcaaggctaaaaaagccgccacgggcaaaagaaaaggcaaaaagaagggttctgccgcaaacaatgaaccgcaggaaaatcaggaagcgctgaaatggaaaaggctggcgctgaccaaaaagaaaaagctccggataaaaataccgcaacgccagtttatcggggaaagccgggaactgtccgaaaagatagaccgtaaaatggagaatgaaatcagaaatattttaaacttataacaacatggaagaaatttttatcgcgatcatggaacgcatcgccgaaaagatgcctgaactgtcatacattgacgaggactacggacagcttgaagccggggcggaggaggaccactatccggtaaccttcccctgcgtgcttgtcgggaacgccgaatcggactggaatgacctcggttacggggtacagaaaagcgagtcactcatcaccatacgactggccattgactgctacgatgacacccactacacctccggaacctatgacaaggtaagggaacggcagctgaaggccaaagagctgtacaaagccttgcaggagttccagtgcacggaagagaccagcccgctggtcagggtaaagagccgggactattcgctgccgggaaacatcaaggtgtacgagacggtttattctttcacgctgcatgacgagtcggccatgcagtaaggggaaggttcattcccccgtgaacagggaaagctggacggctgtcaggcggggtttcttaacctttgggacgggcttcacctccaagtccttcagctcccggcacttgcaccggataatggacatgatccgctcctcggaaatgaaaaactcctggcgggacaacactttcagggcatcatcaaaacgcaggcgctgcacctccgtccagtaatagtaacggcggcacagggcttcatcacggagttctatcagttttttgtctcgtcctttagccataagttcaggtatatgctgcaaaattaggcatttaaccggggatgttaataaaaaaacgccgcatcgtgtatgaatgcggcgtttttctgtttagagtgtgaacaaaatcacatggtcatcagttcggtgtcatcctcacccggaacaaacggctcgatgcgggtgatcaccttgctctgtaccttcacccgcccgctgccattacagaccggacattttgcggataaaggagctcctccctggtccaggtaaaagatacgtcccttgccttcacaacgcttgcaggccatgacgtgcggcgcgatgttcttcgtcttctccatgactacaaccggcagaatgagggttcgatacggtgccagacaccgttttcgtcacgtttgtggaaatagtagttcaccgcggtcttgtacaccacgttgctctcacggaagaggtccatgatctccgtgtactcgctgtcgaaacggtcctcgagctcgtacagcttactcacggacttgtagtccagatcgccctggcggttgcgctcgatcatggtcatgccgagctggtacatcgggtcgtcggtacccagctcgcgccccatggcgtagcgcttcaggtaatccaccaggcgttcggcggcaaggtcggcacgctcgtcgaaactcttcaccttgttgctcctcacctccagcttcatgtcaccgtccacgatggtgaagctcgcctgctcgtccttacgcagctggccgtattcacgcatcaccgcacggaaggcggcggcctctttctccacccagtcgcggaacgccttcacgtcatccacaaccgggagcagccggttcttcacttcaagcatgaactgcgcacggaggccctcataggcatcgcgccggttacgcttgctttccttctcttcctgctggagctgtttcaaaagctccttcctgtcctgggcggacaggctttttaattgttctttcaaatccatagctaaaaaattaaatggttgctattgttgtttattctcacgtttacggcggatggcacgcagcttcacctgcaacgtgtccaacgcctcacagtcaagttcacggaactccttgccggcgatacggctgtcccggcagaaggcgttcacccggtcccagtcggccgtatcgatacccagcagctgcatctggtgcagtaccgcggaacgcttctgacggagaatcttccggagctgttcctgataagtgggcggtaccagcttctgcatggcggacacggcggcactgtattccttcagtgtcatgtcacgcagactcgtggtacgtccctccgtgtactgggaaacgatgctttccttcagtgcgtcacgatccgatgtcggaaggcggttcaaaaggctgtaaaacgccgcataattctcgggtttatttaactgcttgcggctgttgatgtctatctgcatggctatactgtttttttgtttattttaaggtcattgatttccttaatcactctctttactctgatagtacacaaataatcaagaagatgctctttttcattttttgtacacttatactggtcgaaaaattcaagtatgcccattctattcagattttcattaactcaaactattcataccacatcagcacaactctatgatttcacccacggcagagcgtagaagagtacgcaaaaccgaagggtttccgctatcatagatgacttccacacaacactcatggcgtgcgttacgtgacacaaccagctcgcaagtcatattctcacagagccatttttccactactttacggacaccaactgcggtgaccacaattaccatttttttactcataatattgaccgtgctgtatgttattcaactcttatcctcccggtgtactggtttccccgaaacttcatccccttggtgaagccgcccggatatcccagttccttgcttctcgcgtttgccagcaacaaatgttcccggctaagggaggctacaaaacctttgtccttttccagtcccatctctcgggccttccgggtgacgctgcgttcggaaacaccgagcatttcagccagctcccggttgagggtattgtgatagtggcgacgcatgatggaaagcatattaccgttccaaaagatacgggtggaatatcccttatgctcgacgagccgtcccagtgtccggtgcatgaaagtaccgtcagcaaccttccggtgcttgcggtactgttcacgcttgtacaccagcacacattcatgacaccaggaactccgtcccccattcttcaacggatagaactcacgcatccacaactttcggccgcaatgcggacagacacgtttacgtttctgcttgttgttattttcactcatagctgtttatgctgcattcatcagttcatattcaaattttcaccgaacggaatagtattaatgtcagcctttctcgtgtaggcctgcataagtcccacggaaagcagcatatagacattcttattcgctttgacaaccccggaaatagagccgacaatatgttcagtcttgccggtaatgattgagccggctatctgctcaagcccgtctggatggtcctcactggccgcaacgctcataaaggcactaagatcgttttccttacaaaagttatccacgtattggcagagttcctttactgcctctttctgtttttctgtaatcatttctgttaaattttaatggttaataattatatgttgaaatcgcgaaatctcttttttgatactggctgtacatagtttcctcccaatccgtctcttcctcctccggaaggtcatcctcatcaagttctacctccttacggtaaatcagataccgtgcctccagaaagaagaggaccacgcggcgcaggaactcacgggcggaggcgatgccgtgcttttccatgaaggaggcgatacggtccggaccgatagtgttcgtgcggatgctcaccagacactgccggcggaagtccttcagcgtgctgcccctcacctcgaacacgcggtcagcgatacggccgagactctccggaatatggtatccggaaccttcgtcatccgttcccaccagcagttcagcagcagccgtcagcataccctccacgctcatgcgctgggcagcggccgtctccttcaggaacacgtactggtaattgctcacgtaggtatgtatgaggtagccttcaggacggcggaacacctcttcggaggcaagctccatcgaaaggttgttcaatgtcacaccggcaccgcagcagaaggcgcacaccaggcggacgacaagacgctggcggttgccccagccgccagcgatgatggcacgctgcaggctgccggcaacggccggatccatctcgaagaacagcaccgacttctcctgacggcggaagaagaacgacatgtccggaatacgatccatgcagaggaggatgcgccgggtggccgtggagaccctgccaccatccgtcatgcggatgtaggacttcaccaggtggttcatcactaccgtcatgtcggaaaaatgatagtcggcaaccttcccgcggaacagttcatgaagcagaacgggcagcttcacaacgtagttgtaatactcctttctcatggctcacttgcttgaaggtttccagtccactgttataatcgcatccagctcaccgctgccgccacacaccgggcaggatacatgcacgtcctcgcggctgccctcttccgttccccagaaccagccgttgcccttgcagtaaccacacttgtggccggtactgacgaagttctcacggttaggccccttacacatataggcgggaggacaaatctccagctgtttctttatcctgctcatgcctggcctcctttctgtttcggtcccgccacattccaatagtcataggcgcccttctcccagattgtgtattcaccagtggccccctgataacgtcccttactgaaggcgacgtagccctctacccatatcttcaggtcggcatcatacatcacgctcgtggccgcatcacctttaggattcttgccacgggcatggctgatgaaaacaaacagcttgtccggaaactcctccttcagctggatatagtcacgatacgtcatctgtgtgtattggaagctgtcaatgatcacgatgttgaaactcttatgacgccggagcctgatcttcaaggtggggatgtcctccttgatgaacgccaaatggcggcttacctcggccataccaaagcgccgcaggttattctggactgtcagagaagttccttcctccagggagttgaacgccacacggtcatacttgcaaagttccttgcagagctgcatcacgaaagaggtcttaccgttaccgctgttgccccacacgaaccagcagccccggacttccggagtgtcgaaggcatccttccatttcccttcgaaagggaatacgtcatacttcttgttcaggatgtccctgacattcaaggcacgtctcatgcccgcttttttattatcctttttctcttcttccatggtcagaacagtgttagttgtcggatattgtcaattcggtcaagtacggcctgccgtgcggcaccccgcagtttctcgtggcagagcatcctgccgagtgcccacaaaagggcattctcacgggtggcaaactgtccccatttacgtcccgggttgaaaccaccgccggaaccgcccacctccatgtgaacgccggcaacccaccagccgtcctgctgtcccacaagggcgtccaggtagtcgcgaccattccggtaaacggtcaccgtctcgtattccctcaagactgggtaatcgctccagggagcgggaagctgctcgcgaccgtcgatctttaagtattcaaatttgttttccatatccttaaaattacgtttgaacggtatttgaacgggggtcattcccccgtcatgcgtttcaccttgtgaatggacttcctcacacgccgcaaatcaaagtcacatgtcgaagcctcctttatcaccttatcgatgtctttcctgtcagtcacaccgttggcggaacagatcgcaaacacgtcgttcacgtccgtaggctccaactcataaaatttccgtccgatacggctgtagaactccttgtagccgggcttctggtaccgcaagccgttgctgatgcgcttggcaatataatcggtactcaagaacacgacaccgcatttctcctccagcttgttgtacaggctgatgaaatagtggaacaccggttcggtcagcttgtccgcctcgtcgaacaccagcaggggcgcgtccatctggatgatgtcatccaatataagcccccacacctcacggatattatacccttcggtccggattccgaccgtacgggcgatctcgcggacaaagtcacctttcttcatgtcctcagagcagaggatatagaaaacctccttatgctcctggaggtaaacacgggcggtggtactcttgccacaaccggcctcgccggtcacccaggtaacattgcgccagcgctgcgcatcggagagtacagccgtgatctcctggtaagcaccggtctccacgatctgccagccggtagcgcttacaccaccgacctgcgaggcgacattacggaacatctcgtcgctgatattctcataacggccattcaggatattgctaacagtacctacactaacccccttcaggctgccagcagccttcgtctggctcgggtatttcgccacgtaagcccggaggctttcactgatggcgtccttttctttcattgtaatttccataatcaatattttttatcttgttataaatctgttccttataatttcccgaccaccttgcggatgctcacttccttcttctcaaagctgtcccatgtcacgttgctgatgactttcatgtctcggccgatggaaggacgggccggctggctgtattttcttgtgcgacggtcaatctggcgttgcgcctcctttccgagacctttcaggtcaggggtacgcagaccgttctgttccggtgcgacaccatgttcgtactcgatgtccttggcaacgacctggcggtttatacgctcgttgatgacggcctcctgctgggcgcggatgaaacgtttctcggcttccgtctgctcctgctgggcacggtggatcatcagcgggaacgaagccacacactcaaagcgcatcgctccgcccttatccttgtacagcagacgtacgctgctcatgtcataaggatcgtactggacatagaacttcttgtaggtgttacgtcggcgccattccagatcaggctcaccgggggcggagaaaacctcgtaagggtatttctttccctgtaccgtgatctcgataccgttggcggtgaacagcgacggtttctcggtcgtgtaccagaacatctccaccatatccgacacacttaccgcatcggtagcctcgttcacgctggtattgtacatctcaatccgggagatgccggtggcagggtgtttcattgaattccactgctcacgggcggcggcatactgttccttcagttcctccaatgtggggagggagtcgatgttcgcgttgatgaattccaaattcggacggcttgtatctctctttgccgtaatattctgcccggtgaaaccgaaacgtttcttcaatacctggctctggaagcggtagaaaatgttctcaatcgtcttagattcgccattatacggagctgtcgggcggtggatacggctgatcttcgagaaaaggcccagcgccgcgttcttcttatgaccgccctggttatcgcacacgatctcgtagggtttgtgccggctcgtctggatagccatgcggaaagcatggtactgggcgatatagtcctcgttgtcgctgatgtaataaccgagcaggacttcactataggcatccaccacctcgtacacgcttgtagtgcacttgtttccgttctcgtcacgatagtagaggttcagcttcgtgccgtcgccataccagaggctgtcacgacggcccggaaggatggtccggtgcttgcggtcataacgctggtgtgccttcatttccccataaacggcatcgtaccacagaggttcgacacgcgggctgttgaaccattcgcggaggctgcggggactcttcaggggcttccagccacgttccggagcgacacggttgtactcctcgaagatctccatgtcagtataaaccggaacgcggctgcgtttcaatgctacaaggtaacgcccgccgtcctcctcgatcttcagcgtgttgctgttgccgtatttaccgctcacaagcacaccgtagttgtcgggacggaacttgtttatcagggctttcaaacgccccacactgcccggaagactgtgcccgtacaccggacgccattcctcactcgtgacaagcagaagttcccaaaggttacggcggaaaccggtcagcttgttattggatgaactcaagcgtttgaactcttccatcaacgcgttcagcaccgaagcgttccaggtgtattccttcttcacatcctcgggaagagcgaccatctcaccgttcttgtcgtaacggtaatcctcgaaaaagttctcggccttctcgtctttcttcactatgttacggatcatttcctgtctcatttgtttctcgggttcgccatgacgctcaacccaacgtttcttgtatttctcgggaagggaggaataggcatacagagccggattattttcaccaccgccacgggaaacgacatccagtttttctcgggacagctggctattcaaagtgcctttgggcattatatccagcaactctttgtaagttacacacaatatattatcaaagtattccatctcccagcttgattatcaatcctctaaatcattcaaagggacatgcttcttcagcagccgcacggagatcccgaaattcaacactacgagaagttccagcagcggattaataaaaaaaatagagagcaggatcccgaaactcatacagaagtaaagcacgcaaaagcgctgttttcgtttcagacgagcaaaccagtgcagctggtcgctgaacaatgtcatcaaatcatttttcatggctacttgtattttgaggattaccacctactttggatccaccgcgctcaatggcgagcttacgaatggaacgggccagtttgctgttcttacggaaggcaagcgcatgactcaccatcacgtttgtacagcccatcagttcggcaattttattcacctcaccgtattctacaactattcgttctttcatactatctaatatttaaattatcgtagtgggcagtcgcggattcgaaccgcggaccataacctctccattataggagtttagtttgttctaccagctgaactaactgcccgagaaaattattaaagctcctttatcgcatcctccggaacacatattacagtccaaacctgaccatttttcatataatcgatattatattcccgcacgaacgtacaaatgttataatcccagtcacgaactataccatcaatgatctcaccatttctcttggtgattctcacactttgtccctttttaaattttacttccattttgcttctttttaaattctcattgttacctcaagccttttttgtagctttggggcgtgtttaaactttaatcacgtggcaaatatagtctaagtttcttagacaacaaagtattaatccaaataatttagatttatgagcgttttttctaagaatcttagatatctaagggagagtaggggacttaaattagatgaatttgagtttctgggcatcaaaaaaggtacaatgtcaaactatgaactgggtaatacagaacctaaattgagtttgttatgtgaaatatctaagttttttagaatatcaatcgacgactttcttttaaaagatatagaagccgaaaaaattacaccagtagtaacggaaacagctcctccagaaacagctaacaataattttagggagcttctggatgttttaagggaaaaagactccaccattcgagaaatggcagaggaaatagggatgctcaaacagacaattacacaacttaaacaggacaagtcggggcgtgtttcggatgcaagcgattctacggttgccaatgccatctaaaacgtgttttatggggaaagggaggtaaaaacagttaaatcactattttacagcagaatatataaaaatacaggggagtaaataaatattatctatatacaatttaccccctacaatattataaaaaccgatgaataccaaataaaaaaaagatatttccccgttttattagaacaaaataggcacaaaaatgaataaccaaatgaataagcaatcaaaacatttcgtttttgtaatagcttaaatgaataaccaaatgaataagcaagtgaataacctttccactttttaagacgttcaaagcgttcaaacggataaatacagccttccatcatagtttgacacttataagggcaaaaaaagccgcttttgcggcttttaattgcgttctaaggcattttatccctttctggtacatgttatcaagcgagactgaataatcattgcacgtttcgtgtatttggcaatgtcatcaaccagtccagcatgtaaaagactactcttagtgattccgacctgtttctccgtcagagtttcaaaaatggccgatatactaccaaagtagatgttctttttctcaaaaatcaaatgtacatggataactttactcatgatatatagtatttatttcactgcaaatataccaaatatcagctatatggaataattttaataaataaaaataggagagaagcgaagcgctcccctactccacttgcataaattacaccatttggttatctttgtatatggaagtatggcctgggcaaagcatcggagtgaaataataccatactgcctgaattctcccctactccactcctaatgtaaagagattcatttgaacggcgttcaaacaaggttcaaatgtaagctcgatgtaaagcgatgtaaacgcttcgtttttccacccagctcactcctaccccgttctaacgctttgaaaaccaaagcaatcagatattttcagaccgaccgaactttgacacgcatcgtttctccccccttattcaaagcccaaaccgattttcatctgggtaatacccttcagaacgatttcacccaagccgcctgccgcaatcatagctgcaatgacaaccatggaaagagacatcataatcgtctggttcactccggtcaggatagtgggcaaggccagaggcaactgcactttataaagcagctgccaccgggtggccccgaacgaacgcgaagcctctaccacgttcttcggtacctggcgaatgccaagtcccgtcagccgaatcaccggaggcattgcaaagatgatggtggcaaacactcccggcaccacccccagcccgaaaaacaggacggcaggtatcaggtagacaaaggcaggcatggtctgcatcaggtccagtatggggtgtatcactttctccgcacggttactgtttgccgtccacaccccgatgggcacccccacgataagggcgagacaggtagatgacagcaccagtgccaatgtctgcatggtggcctcccaaaagcccataccgtagataagcagcaaccctaaaagggtgaaaaccgccaccccgcgcccggctttcatccatgccagcaacaccattgcagcaatggtcagataaaaggggataccaaacaagatatgctgaaacccattgataaaactgccgatgcccagattcagcgcatcgaaaaaagcggagaagtgtatcatcatccagttgatgagttcttcaatatattgtcctatgttgatcataattctattgcattttgaatgatttcattgatttcctgtttgttctttccggtcacttcgaaaatgagcgatgacaaggggacgactccctgaaattcacggccttcgttcaccacccagataggagaattggttttggtcatcagcggcaggatgtcttccaatatcgtatctcccagcaccgaatgcacttcttcgcgaacgaccgactcgattgacttcacctgctctttacgcaaccggagcaaatccttcaaacgcacctctcccaccaacacattgtttgcatctaccacaggtaacacggtcagattatgttcgaacattttacggatcagaacttccggcccttctttcttcaaccgggccacgaggggtttatcaaccatcaccgaagcggcggtaatgatcttgctacgatccacactctccacgaagcgttccacataagcattcgccggctctgtcagaatctcctccgaagtacctacctgcaccacttccccatccttcatgatggcaatccggtcacccagcttgatggcttcattcaaatcgtgagtaataaacacaatggtctttttcattttagactgtaaagtcagcaattcatcctgcatttgtatacggatcaaaggatcgagggcagaaaaagcttcatccatcagcagcacttcaggatcgttggccagagcacgggccagcccgacgcgttgctgcatcccgccggacagttcgctgaccatctgattctcgtaacctttcaaacccaccaactgcatactttccatcgccctgtgctcacgttcctgttttttcactccttgcagctccagcccgaaagctatgttatgcaacaccgaacgatggggcaacagtccgaaatgctggaacaccatagccagttcttttctccggatacggagcagctctttatcggtaacattcgaaatatctcttccattgatgattacctcaccggaagtaggttttatcaatcggttgatacaacgcagcaaagtggatttcccactccccgaaagtcccataatcacgaatatctctccctcccggacagagaggtttgcgtcttttacggcaaccgtgcatccggtttcctttaagatctcactcttactctttccttctttcaacatacgcaaagcatgctgcttgtcgttgccaaaaatgagatacaagtctttaatcgttattttactcatacataatagggtttagattattaaaaaacggaccgggcggcctacacacacgaaaacaaacacttctttatagtaaaaaagttgataccggaaaacaacggttgtgttgttcccccggtcaaatatgatttcttaacccggttattacagacaggattcctgtcaacagatagttactatatcccgaaagtcaaattcacatccatacacaggtattacccaaagatgtgtgtacggacaattaaataaacaagccgagcgttcaaatagttcatcacattattttcgatgaacacgccgcatgtacataaactgccacaagaaagccggcatcaccccactcaaatactgtcgctcttccacctgtgaagtttaaggtcgacacaaccgttttttcggaatgaaacaccttcatcggacaacagttgccgttgttcatcccatccgggcaccaatcgtcctatggcattgactacccgatgacaaggaaggcttaaaccggcaggtacctgcttcaatgcacgccccaccatacgtgaatattgcggcatcccgagcaaagcggcaatatcaccataagtaacaactctaccggcaggaatttcacgcacgacactgtatacttcattgcagaaagtttcggacaaattagatttattttctttataatctttcataggtgtatcgcttttatgcagcaggttcttttataatccgcttctttttaaaaactccgtcgggctttcaccgaactgttctttgtagcatttcgtaaagtaggaaggtgacgtaaaacccacttcatatccaacctctgctatcgtcatgtccgaagaggccagcagcgaagccgctttcttaagccgtgccatgcgaagcagttcgttcggcgcaaaattggtgagcgacttgatcttccggtagagctgaacacggctcagccccatctccttgcccaaatcttccacattcagttccgaatcacccatctttgcttcaatcagggacttgaaccgttcgacaaaatctttatccatatcgcagatatcctctttggccaatgtctgccggtcgccaaagaactgcttcatgcgccgtcgcgactcaatcagattgcggatacgagtcagcagcaactgcgaactaaaaggcttggaaatataagaatcggctccaccggcatatccctgaatacgctgctcgtcaagcgaacaagctgtcagcaggatcacgggaatgtggcaggtctgcaattcccccttcaaccgccgacaacattcgataccatcaatccccggcatcatcacatcggagatgatgacatcgggaacatacttcatcgctttacggattccttcggtcccgtccgcagcttcgatgacggagtactccgaattgagcaatgtgtgcacataagcacggatgtcagcattgtcgtcgatcacaagtacagaaggtttggagggatcattgaagttctccgcttcatcctcccggagcaggttatccacccggtccggagcagatgcctccaccggagcagatgccacgccggtctccgcttcgcatgtccgcaccggcaaatcgacggtaaagacagttccctgccgttcgtcactctccacctcgatgattccgccatgtatctcgacaaacgcttttaccagtgccagcccgataccggaaccggtatgatgcctgtcgatcttatagaaacggtcgaagatgctgcggatatgttctgccgaaatcagactcccggtattggcgactgtaaaacggaagaaaggagtgccctctttctgcaaagccgaaagccggacagtgactttaccattctcgggggtaaacttgaacgcattgcccaacagattgaagtagatacgctccatcttctcagcatccgccagagtgtggtaatcggcaccgggcatgctgtcgaacgaaaaatggatatgcttccgccgggcggctgcctgaaacgaatcgttccactctccgaagcactgcaacaggttgagcgggaccggggtaaactccatctttcccgtctcgtatttgcgaaaatcgagtatctgattgaccagacgcaacaggatctgtacgttgcgctgcaccagcaacaacatcctgcgccggtcaccctccaatgacgggtcggccaacaactgctccaccggatcggcaaccagagtgagaggggtgcggaagtcatgtgaaatgttggtaaagaaaaccagtttggcatgtgtggcttcctccagttgatgggaaagttctatcagttggtctctctgctcttccagttgctccttctggcgggaaagttcccggtacaggcgattcttggaacggagagatttatacacgacaatcaacaatccgacgatcaacaacaggatgacaaagcccccatacagcaccacctgctgcgtggccacccgcgaaagatacgtccctacccggctgttgagcgtctcgatttttccatccaactcgctgatatgggctgtctgcaattccatcacgtgcgcatttaccgcgtcaactactgctgtcttcagttttgtctcccgtttaaaaggtttcttttgcagaatatccatcgccagctgaaccaccttgtctccttcggtgggataaatgaaggtagcatccagcacgctgtccagtaccagttccactccgttacccttgccgggcagagcatcgatacctacaaacagcatctcctcctcacgtcccagacgtctggcagcctgataagcaccggcagccatacggtcgttcatcccatacacggcatcaatctccggaaaacactgcaagagggaatccatctttatttcggcaggctgcctcaaccaacccgcatcttcccgggcaagcaaggtgatgcccggatactggctgatggcactcataaagccttggtgacgttcgatggcaggagtggaaccgacaagtccgctcagttcgactacttttccgcgccccttcaggcgatgggctatgtaattgccgacggctttgcctaactcgtaattgtcggctccgatgtatgcggtatatttatcggaaagtatcctgcgatccaccataatcaccggaatacctctatcgaaagcttcctccacaacaggagtgagagccattccctcgttggcagccacaataagcaagtctaccttctgccggatgaagtgacgtatatcttctatctgtcgccggctgtcgtcattcgccgtacgcgtctctacctctacgcctccgtaaaataaggcttcgcgctgtatctcgtcattcatcttatgccgccaggtatcatcactgcattgcgacacgccgatgacgtaccgggaagcatcatggctacacgagacaagcagtcccgacaaaaccagcccaagtaagaaaagtacacgtttcatggttggttattacataaaaggttccggaggcaaatataacaatttccctccgaaatcttccatccggccggtttaaaaccaagacggatgtgtgtcaaaactcaccacagaggacacagagtaacacagagatgattttaaatcgttggttattaaaaagactctgtgatactccgtgatactctgtggtgaaaagagttatgacacatccccacgactctatcaaccaatcaataaccctatataaaccaacacattaatcatctaaacgatttctcagagcatccggtagtacgggcatcgcaccgctctgtgtacacacgtaagccgacacttccactgccagtttgtgtgcctcgggtatactctttcctttcagaacagatgagcagaaagctgccgtgaacgagtcacctgcccccacggtatcggcaaccggcactttcggggtttcctggaaagagaccgcaccgggggtaaatacataactaccgttcgtaccgcatgtcaggatcagcatcttcaggttgtacttggccaacagaatccagcatttatcctgaaggtcgatgcccggatagccgaacatacggctgatggtaaccagctcctcatcgttaatcttcagcacgttacacttcaggaaagattcgcgcaacacttccctggtatagaaactctggcggagattgatatcgaatattttcaactgtccatccatgtcgggcatggtgtcgaggaagcggttgatggtggcgcggctcacctcgttgcgctgtgccagcgaaccgaaacatacggcccgcgtgttcagtgccaaacgcttcaaatcgtccgtgaaggggatattgtcccatgctacgccttccttaatatcataacacggcactccttcaccgtcaagagtcacctgcacggttcctgtcggataattgacccgctcaagctggtgcttcaactgtttttcccggaatacttccagaatttcatctcccagctcgtcgtttcccaccgcactgaccacacggctgtcaaagccaaactgcgacacatgataagcaaaattagccggggctcccccgattttctttccttcgggcagcacatcccaaagtgcttcgcccattcctacgattatattgttcatggcatgaattgggaagcctcacctcaggaaggtgtgtcggaactcgtattcaccatagattacacagataaatatccattagctatcaacagattaagttctctctgtggaactctgtgctactctgtggtgaattataacacaccctcaaggttaccgcttcattatggttattaaataaattactttctgattctcaatgtatagaacatcagatagagtaccccgaccgtcatcacggccacggctccgctctgtcccactgcatccgaagccactcccattgccagcgggaagatggttcctccgaaaagtcccataatcatcagtccggaaacctcgttcttcttgcccggcatataaagtaatgcctgcgagaagatgataggaaatacattggaatttccaaacccgatcagggcgatacaaacgtaaatcatcgtctgatcctggaaaataaacaaccctgccatagccgccagcatacacaacacgctgatggcgaagaaggttttggctgccatcttctgcaaaacaaatgcccccagaaaacaacctgccgtacggaagatgaagtagagactggttgcaaacccggcatctgccagagtcatgcccagacgttccatcaaaatcttcggtgctgtggtattggtgccgacatcgatcccgacatggcacataatgcccagaaacgagagcaggatgaaaggtttgcccagcaaagccagacactgcccgaaagtggagggcttaccctcttcaggctcctcggtgatctgcgtggcattgagcatcaggatggcagcgactgccaccaccatgtagatggggaacagtacccgccagcctaaatcgaaggtagggatagcctgcgtagctccccacatagcgatgtaaggggcaaggaaagaggcaatggcctttacgaactgcccgaaagtaagggtgcttgccaggcgttcaccgctcacgatgttggaaagcagcggattgagtgatgtctgcatcagtgcgttgccgattccgagcaacgagaaagagaccaacatcagcagatagctgtcgccaaagacaggcagcagcaacgatgcaaaggtgatcagcagactaagcaacacggtctttttacgcccgatgcggttcatcagcattcccgtaggcaccgagaagatcagaaaccagaagaacacgagcgacggaaagatatttgcctgtgaatccgtcagtcctaaatctgctttcacatagttggaggcaatgcccaccaagtctacgaatcccatggcgaagaagcagagcatcaccgggataagtttcatgtaagagttgtttttggtattttccatgatatgttaatttaaaaaaagcagatttaagctacagcctgtacaccttgcactggctgaccttgaaagctcccccacggctgtagaaactcatctggttatagggagttgtggggaatatcaggtttgtcatggcaatctttccaccgttcagaaagatttccaccgaacatttatcaacaaagatatccagtttatagctgtcggccttcttcaccggagcccaggtacccaaggcaaaatcgtccacatagttgatggagttctgcttccggcggtcgtgtgcctcgatggcatgaggggcgctgtcctttccgaaatctacaatgccgctcttagtgcggtccatcaccagtttcttctccggaaggctgatatagatatctacattctcccctttctcattgaacagtttcagtcccatgatttccgccgaaccggcagccaattccagctctatctcgtaagctccccggttatcggccagcagtgaatccacatgataggcgtccgccacctcaaaggccggaatctcccgcgactccttacgcagcgacttcgtctcttccaccggagcggcagccatatagatatctccatcctgagtataaaggctcagttcgcgaggcaacgcattggcactacggaactggcgggtaggcacaatattggcatactgccagttgctcatccaaggcacggcaatcgtacggtcacccgtattcgagaagcagacagtcgcatagtgatcttttccccagtcgagccacttcacagtttccggcttattgtcgcaaacaaatttctcgccgtcaaaatcaccgataaagtactgagtggcacttccaccgaagtagcatcccggattcacgttgactatcaacgcccatttcttatgattcggatcaccgtccaccggaagttccaccatatcgggacactcgaactgactgggctgaacaccgtagccttcgccccaaccgctcatatacgtccagtccttcaagttcggtgacgaatagaaacgcatctctttatcggccgataccaccatcacccacttctgatccggagcataccagaacactttcggatcgcggaagtccttcaatccgtcaaacggagtcaggatggggttcttttcatatttggtaaacgtacgaccattatcggtgctgtaagccatacactgtatctgtccgttcttgtcactggccgaggtatagaaagaaacgatggtacctgcgccgtaaccggctgtattggcatcgtccaccaccgaacttccggagaagatatgccccaacgtatcgcgggcaagcgccggttccagatgttcccagtgtaccagatccttacttaccgaatgcccccagtgcatgttgccccacatagagccgtaagggttatactgatagaacagatgatattcgccatccttgtataccagcccgttggcatcattcatccatccgtaaagcggagtatgatgatagacaggacggtatttgtccgtattggcggtatcaaacgtatccgagagtttgagctctttccagcacaaggcatctttcggtaagtggcggatgcgcacagctacttttttctctccttcaggtaaggcgtaagggacgaaatagtccaccttcgccctcgacaggcgcacgtccatctctaccggaaccgaatctgacgcaatgcaaacctgcgcttcgggagtctgttcttcgatgggcaaaagtaaatatcgggtaggatttgtaatatgaattacggtaaggctgtcgccttcttgttcaaatgtcatttcagattgtgagctctggcaagacgaaattccgagtaaaacagccaaagtgccgatcactcttctacttacattcataaaagttgttttcatgataacaggatgttttttattagtaatgcaatagctgtgtttacgatggcaaagatagcggagttatctgccaccggctattatttttgtttcaaatagtataacgattgataccaaaccgcgtcagaaacgaatgctggcagcaaattccacggtaaacggacgaatatagctgcctgccatccaatgaccgttataggatgccgcgtcttttttgtccaccagttcggcaccggcaatacttcctttggctccggtctgattgaggaaattaacgactgtggcactcaatgcaagatgtttgttcaccgtccagttgacaccaccgaaagtttcccaacgcccgttgaagtagtaagcatttttaatgttagcgtacgtcttgctgaaatagcggaagctggcccagactctgaggtcgttcgtaatgttgtagctgggatcgagttcgacaagcactttcggaatctccgtcacaatatttcccgtggcattgatttcacctatcgtaccgcccttgaaagtcacactcgtttcatatttcttgtaagtcgggctttggtaggtaaacaggaaatggaagttgaagcctttgaacggtttgatcactgcatccgtcgtccagccgatggtcttgatgtcataactcaacggagcggcaagaatctcggtccggtcattcggattaatcagattgagcgtcgagttattgtttgttttcgaaatgtaggaaaacagagaagtcaggctaatccagttcgtgttataatagaccccggcacgtcccaggggaacggatattttatcggtattgggcattgtggcaggtgcaaagttcgacaaaccgggacgttgtgtattgtaagtaaagtcggcggtgaaaccgaactcccgggtcagtttataggtagcggcggcagtgaatgccatgttcatccagtcgtaatcgaaagggcggggtgtaatcctgactcctttatcggatacggcgcccagataataatctgcgaaacggcctacggcatttccttctgcgtcatacacagccgcattctctccttccagatgctgccattccagacgtgcaccataatatacattccattggggagaaatatcccagtcgtgggtggcataaacagctaacttgttttcgtgccctttgtagtattccgaagcatttttattgaaatcgtagtacacaccgtccgtattcccctcacgcaccagacgctcgggatactcttctaccgtatggtcgtacatggttgtgttcgaagcataatccactttgtagtgccattcgttcacaccgagcctccaggtcatattgcgatattggcgtgaaagttcggaagtggcgaagaactcgtcaatcgtcccccggttaaagcaagacatgcgactttgcacatacccttcatacggtttcaacgtaccgtccgttcctttcagaaaatagccggcggaggcatccttctgttccatggccatcggggtctgatagacatacgaacccaaggcatgatcatacttcaggttaaccttccagttcagaccgttgtcccaagtataggtattgagcaaagtcaactggtttcctttattcagagtggcatcataaagattggtctttttcagctcccccgtacgcatatcacgataaaccatttctcccgtggcaggcaggtaagaacttgttccgaggctgaatcccggtatttctttcacgctgccgtctccaacatagatgaaaggagcggaagtcgtttcattactcggccaacggctgttgctgtagtgatagatggccgacagctgtccgcgcccttcgctataattcttggtcaaggctgctttataaatttgagtgcggtcctgattggaagtaaagcgcagtttgaaactgcccgggtcaaagttctggtagacacttccactgtaaaaccagcctttccccataccaccgctgatattggcatcgaactgctgcttgccaaagtggttggtgctgtaattgacgattccacggaatttctcagtccccaactgagtaaaagagtttacggcatagccgatatttccggtagtaatagcggtttcggagatttttagcagtccgacgtgtccaagactgctgtctccacgccagtgggtatttacgttatgcggattagaggtatagactacaggaagtccgttttcgagtacgtttacgtctccaccaggcaggccgatagagatttcgcggggaccattggcgctcgaagcgttcagcataacgttgcgattgctttcttctttcgatccggaaggtgtccgggaagattctttcttttcttgtgcggttgtgaagccggccatcaggaagcaagccagcaaccaaacagccctttttttgttcttcatcatggtacttaaattttttagttgattgagattgttttgatgccgcaaaggaacgcggaatcccgtttctcaactaaaagatttgtttcaaaggctgctacttttgattcaccggcacattacatattaattatcaatcgtttacaaaaacagaaaaaagtcagtttacagcaataaatatgagatgataccattcttccttcaattgatttatagaaagaacagataaaagaagatatcagatacgcaaaatcactttccttttccttccagcagatctgcgatcttctgcttcaggttcagtttcaacatttcatcctgtcgcaactcgatctctaaagtgatctttgcatttcccattttaaacgtctcctcttcatcaacagggagagcaactcctttttttatggaatatagaacagcaaaatcataatccagtgccaatgacaaactatacagcgtatctgtatcaatgctctttcgtgtcagcagatagtccacactctgtggcctcacccccaatctgcgggcaagttcggcttttgtcacctgcctttcggccatgacctgttttatcacttcacctatgtatacattactcttcttcatattctaaataccattcagtcgtcccaaatgccaatcacgtaaaaatccccgacagccgtcacggacaccggggaggtataaataaatggacttatttataaaatcacccacccgaccgataacctatcggccggatggagatagagtacaaaagtaacatcacatttttagaatgaaagggggagtttatcgaatacttacgtcacactctccttgcgataatcctgaaagggacgaccgccgacaataatctgacgatagaaataacggagatcgggcaaagaggaaagatgacgggtatagaaacgaagcgtataattgccagaacgaagcgtatcacccaaagagatgtaaccggaaaagacaccgtgatcatccttcaccatctcacgggagatgacctgactgtcagccaacagttcggcataaacgtaacggctgtaagccgttgcctcgaggcgggtatccatcaggtaagcacggaaccgcaccgtgtcgccgcgctcataattggcacggtccgtatggacataaagtttctcatgaggccagatagaatcggactgggcagacagccgaataaaagagaaaaaaagggcaatcagaataaggagttctttcatacataatcaggattaagtatcaaggaatatttcaaatataaacacatattttgaaataagcaacgaaaagagtgcaaatatgtggcacatcctgaatattcatcctttttcattcgttccggagcttcatacactttatttccttataaagaattgacacccatttgcaaacacagacatcaaaaagacaccgaattgcaggtttcacttacaagccctttttgtttccgggtcaaagcagaagaaacagagcccagtaaaagactttttttgcagaaaagccgggatttttagccgattgcacctttgttttctcggaaagaaggaagcatttaccccaaaagaagtaagcattcgggtgaaaagaagtaagcattttcagaaaatgcttacttcttttctgaatatctctatatgttttggcagattacatatattgtaacgataatcgggtggcgagagcaactgattttttcctgcttgcctttcttcggtcgccctttacaaagtatcaaaagagtaggcaaaactcctcgaagaaaagatttagaaacaggaaggtcatacttcctttccatttaccgccattatgaatgaaacaaaatcaaaagcgcaaacggatatttgcctgtaagccgtttttatgaaccttatcggattgcggtccgaaaaaacgagatatagagaaatcatattatcaatttgacactttgataaattgacaatctttaccatcataacccgaatggtgatttaaagttcatcggaaggaatcacacagaagaggtgtgatccggcttgatattaaaaagggacgtctttgtgaagatgtccctttcaaaatctacattatagaaatgagcaaattagctttagaacagtttgttaggatattcacctgcatctaccaatgcctggatcttatctactacaccttgacgatcggctgcataagtcacgccgaaccatttgcttgtagtatccagaactttcacacgagcagtgccttcgttcaccaacttgtttaccatcaacggaatgaaatattctgatttcaggtttccttcgttttctttcaggaattctttgaagtactcttccgaataagcaaaatagtcgggagtgaatccccacatattcattgaaaccggagtgttatcaccgattgtctgcatttcaccgttttcgtccttaaatgatactttaccgtcgatacgttcgatggcagtacgctctaccacagtagtcagataaccttccggatttgtctcgcaaacgccacgggctacagatccgctttctgaaagcgtatttcctacacggtaacctaccatgcagtagtcgttctttttaccgtccatcttagacagttcggcacccaatacagcaaagctgtcacgtccgtagaagtcatcggcattgataacggcaaatggttccttgataacatctttacccatcaggacagcatggttagtaccccagggttttacacggtcggcaggacaagtgaagccttcgggcaggttatccaatgcctggaacacaagttccaccggaatatgattttcgtatttgctcagaatcttatcacggaaatcctgctcaaaatctttacggataacgaatacaactttaccaaatccaccacgaatagcgtcgtagatagagtaatccatgatagtttcgccgttaggacccagtccgtccaattgtttcaatcctccgtaacgactgcccatgccggcagcaagcacaaataatgttggtttcataactgtgaatattaaaaggttagtgatgtgtctcatcagatatcgttgcaaaagtacaaaatagaatgaagaatgaagaacgaagtatgaagaattttcttactccgttcatcgccatcgactattttagaacggataacctacagcaaagtgtacccccagccctttccagaaagaaccggtcacattgtaatatcccttctttcccgtatcgtatgggtcatgcaaaggtacgccacaatccagacgcaaaataaggaaatcgagatcatagcgcaaaccggtacccgttcccaaagcaatctgtttaccgaaagtcttccagcgcaattgcttctccggcgcctcatcatctttacgcaacatccagacgttacctgcatccaaaaagacagcaccatgcaagtcaccataaatgcggaaacgatattctacattagcctccatacggatgtccccggtctggtccagataaagccccttggatgttttcgtgggacgaaatccacccggaccaatgctccgtgcagtaaaagcacgtacactattggcacctccgatatagaactgctcgctgtaaggggccgtattagtattgccataagcccagataattcctcctgcaacacgactggctatggactgattcttgtcgatcttccaagtataacggaaatcactgttcacctttaaaaattgagcaaaaggaacaccaaacaactttttgtctttctggctaaacttccgtccgaaaatacggtaaatgccggaagtgatatttccggcagaagtaaacgtagtctgccaccaaataggattacgcaccccgcgcaaagctgcgttatcaaacgtataagtatattccatggccggaataaactgattctgtaaactgcggtacaatgccttattttgttcggctatctcttcaaaagcttttgttgtatgttgcagcacattgaaagtcacccggaggggtgtcaggctgtgacggctggtacgagtcggctgaaaatcataagtggcattccccccgaacgccaatagtttataatatttagcacggttcagctggtcaatatacaaacggaaagtagttgttgccgggaagtcatattcacgtcctccgaaagaaggaaataccacccgggggaaagtcaaagccgtagacactcccatctcccagctattcatcaatgaacttcctttattctgcccggtctgccattcataagaacctttcaattttacattccacgtttctcccccaccgaatacattgtaacgagtcagcccgaaagatgcccccggcccggtctggttgttactcttggtcgtcaggttaaattccagttcggcatcatacggtttatcaaatgtagcctgtaaacgtacgttcagtgtgtcacatgttgccgtagagtcctgaggtatatattgcagatcaagataacggaaaatactcaattgtgaaagacgttcctgaatacgtgtctgccggtattggctatacaagcggctatgggcggagttacgtaaagaatcattgcggacatatgcctgataattcagccaacggtaaagcatattcggacgcacctgcattttcttataataatgaatgtcaagtccacggtattcaagtgtgctgttaggcacttctccaccctttccatacagataaactgatgtcttccctacatagtatgggcgttgggctgcttccggaagcccgggtacaggtatcagccggagactgacatgtccgggattcaacagagtatccgcctgatatttcatgtaatccggacgaaaatagaaatatccccggttacgcagcaaagcgctgatacggctacgttcttcgtcaagatcactcacattgaactgttcgcccggtgtcaacagcgaacctcgtcgccctctctccatgattctcaacgtacgcggattgaaacgagtgtaataaaccgtatcaatataataagggtctttcatgtcaaccgtataacgtatgcttgctttcaggctgtctttcttgtccggcagagtctgataacggaccgtaccattaaagtatccataatcgtgcagcaaattagtacccaccttggcacgtatctccggattaacagtagaaatgaatacgggaggattggcggcaaatcgattaaagagccagcgcccgaatcctttcttataatgaaccagactgttgtaagcccacattttaaaagggataggaatgaatcccaacacctttgtactgggagccttttcgagcgcagcatccagttctgtcagggcatcgtccgtcaaaggtgcctgcggacggttttcaataatagttttcgatccggtataaagcacttctccttcgggcaaatgtttggtcgtagaacaagctcccaaaagcagcattaccaaaccggcttgtatggtgccaagaaatatatgaaatatctttttacgtatcatcctattttaatctcttttattaatcaattactgatgtgcttcaccggttgatgaagccttctgtgtatcaggagatgtcttcttctttttacggaaaataaacaactcacttaatctgtcgatacgcttacgcagtaccaaaccgataccggtctccgtaatttctccttcaagcacactttcataattcttattatggaaaagacggatgtaacgggttccggatgtatcgagacgatattccaaagaaatattatcgataaacgattcaacatcatttgtagcttgtgcaccggtagataccttgccgccaagcactatttggaaacgatcgttgaagaaacgctgtgaataacggaaactatagtcggtacgctttcctcctgcatcggcagcatcatggtcttctacccccatcgagaaactggcattcttcaaattacccgccaatgcgttgatctgactggaaagtatactgtttagtgccgatcccatattcagtccgccacctccggaacttccggaatttgcaagatagagtccggtagccagcatggcaatggcttgcttcccacgttcgtcagcactcatagaagccaactgattctgcacttctgcatcatcgggtgcatcaatttcaaaagccagcgaaaggttatccaaacgattcttcacgacaatcgacacgtcaaagttaaccatacgcgactgtccgctttcgctgcctaccgaagcacgaaggcgctcggtggctttcaggtttagcatcgggtccatcgggtttcccgtccattctacatagctgccattgtttatattgaattctttcaacggaatcacaggaagggcatatttcatcattccccccgtaagggtatatcgtcctgaaagagataagtctccttgtggagtatattgcatgctcagattacctcctccctgcaattcgacccggctgctgcggtcagcactcaaatccgctttcaaccggactccgggatcaatctgcacagtcataatcatatcgagtccgccaagtgacacgacaggagcttcttctttctgtacggtggtcgtatcactgaaagaagtaaaagtaactaggtcccccaaccggtcttgcacagtgagcggcgaatccatcaagacataggtgacatccgtattgcccagcaggttcatattgccacgcatcaccaacgcatccaccggaccacgcaaagttgcattaaagtccacaaacacttttccatataccagactctctttagtacggggagcgttgagcagcatgtagttttccgccaacatcgacagattcactttaggactgctcaaatcgcgaaaatcgactgtaccatcaatcgtgaaaggattcttactggtggtaaaaatagcaaatttgtcgaacatcaaacgactgttcttaatctgtacgggacggttgtcgaacgtaaaccttgctcccgcctgacgggcgaagaccgacacgctgtccagaatcaggtcaccattgaccaatggctgatccgtatctccggttatgtgcagtccaccatccatatcacccgaaaggttaacaacctgatccggtacaaaagcattggctatctttagcgggaaatgctccattgtggcatttacctcgatactgtccttaccggttaccgagggatgaagcgaaccgtcggccatcagaatttcctcaccctcatgggtcagataagtactgatgtaatgtttccctctttcacccggaagccacgttaccccaagtgcaacgtctccgatacgttggcgctcataagtcagttcatcgatactggcctcggcagatacctgcaaagaagtagctgtctgcacataattggcctcagccgagaagagaccggacaaatcaggaaggtaaggaagtaccttactgatctcagccaaccggatgcgttgcaactccacgtcaatattctgcaatgacacggtgtcactctggtttgatttcattcggaatcccatatcttcatcatctaccatatcgacattggcatacagacgcatgtttttatgaagatatatccagttgtgccggtctacgaagtggaacttccgaaaagcgataatggggttctccggtatcagcgtgaaagcaagtccctccccttttccacttccctcaaccaatggacggacattcacaccgaaaagtacaccggtttctcctttatcattttcatagcgcaacgtgagttcggcatcatcgttgcgtatttctccggcaatactcgatttaaatacaatctgcggattcttgggcccgttgatgactcctccatgcaaactcatgcgagtcgtatcttgcttgacagtaaagtaaatcgtatccaattgcagggtatccatcttcaatgcgtgaatagcagcttttccgttgataccccaatcgggagcggtgccaaacttcacacccatatcatgaaaagcaatatcttttgttgccagataatatgccagaggattttctttaccggcagacatcgaaaaaatggcagtaggcaacgccttacgcaattctccatgatcaagctcttttttatcaatctgctcaatcagcacatcggcaaagtgagtagattgttcaatcaacttgtccagactggaacgtgccgaaaggttaagtttcatatcaccagccgtaagatgggtgaaaatacggtcacgacgggtctctgctgtaaaattaaaagctaaaggatgcttcaagggtttgggagcaatacccagttcgtacaagtcgagttgggtaacatccaaatcagcctttccgtccatgtagggtttggcaagatgatattcggcattggcgttcatcttcaacaaccggttgtcactaaccacatgggctgtggcaagtgcattcttaacatcaccggtcacttcaattcccgaaatacggtaacgtccgtaatggagtgactccaacgaagctttcagtgaagcaaccgtacgataagaagtaaagtccgttcccctgcctactgctgctaccgatgtagtcagttcataaatcgaatctttaggcaggaaatgatggagctgcaaggcttccaccttcagatcggcccgataagcctcggtacttccattgtaagccgcatctacattcagtgatccctcaccctctttcagcaagagttgtgccatatattgcggacctttcatccgggcttttgcgacaagcgacatctgattagggataacaagagaactgtccgcccttgttccacccagagttgtcaggaaattaagattctgggtctgcattctcaggtcgataacagccgaccgctccacactatcagtcaggttcagcaactccccacctcccgaaagtgagaaagctccgggtaactcagcgctgaaacgagtgatctgcatctctttcagattgccctccgtaccggcacgtatcaccaaagggcggaaaggataggcctccttgaagctatcaggcaacccaccggcaagaagcagaacatcctgcttcccgatcatcgcattaaagcgtgcggtcagccgtccggtcgtaggaatattcaccaactcccaataggtctgtgccgtaaaatttatttcagaatggggtgtcaacagtttcaagtccggcacccggatgagagtatcattggcaaacacacgcccggtaagtgaagtgacacttaacccggaccggtcgttcatcgaaaactcacggatgacagcattcatattacgcccgcgataatacatcgaatcgagcccgatacgtatatcacgcaaagcaatatgtgacggatcaaagccttcggctggttccatcgaacccacatcataattcacagaagtacccgacaacaaaaagctgcgaagcccgtaacgcagattcttcaaatcggcttcggcctcattgatttgtgcgtctcccacatgggctgccaaacgcatactgtctgccggtaactgcatgctaaaggaaacattctttaatttcaaatggcgtaaatcaactttccaacgaatctcactctgagcagtatctttcggtgtagcagtagtatcattcagaagtaactgaacatgggtatcggataattcggcccgattaataacagctacttcattgggtaaatccaccccatggctttcgagtttaaagctgcctaagacacctttcagacgcataccatctatcaggtcagcagagttaacagtcacctgacgaagagtgatatcatccacttctacttttccacgaaaaagcggaagtgcctgcacatgcacattgaaactttcaagtgataataatgtatcgggagtctgaatgacctcaacccctcttaccagcaaatttaaaggaaatcgcaaatcgatacgccggacattaatctgcataccggtcgcttcggaagcataagcagcagcctcctttctcagaaaattctgtacgggaggaatatagagtaataccatcagtatcacaaagagtatgacaggagtaagcaaaatccagcttacccatttgatccattttcgtttcatgaagcttgtgtctcaatgtaaaaagtgatacaaagaaaacaaaattatccggaaaaagattaaagtgacgatgattttatatatgagtagactcacaacaatcaccgggactgatcctctgacgcataccggcgcgcttctgtcagcacgatatctacttgctgaagggcttcttttgcttttcgtacaatttcgtccgaaatagcttctccacggcgctgctccaaccacgaaagtaagggaagtactcctgaagccccaagtaaagtaaacagaggcaacagcttatgtgccatccctgctatcccatccacatccatggtccggacagactcttccatccgactccggtttttctccgtttcttcaataaaagtttgaataatagctgaagctgcttccgagtcatcctcggaaaaagccgtcaacgcccgaaaatcaagagaggtctccgtcggtctgattggcgaattttcaagggcttcacccgttatcatcgctaacagttccttcaccgtaaaaggtttgtgcagacatcccgcaaacccatattcccggaaatcctgttcgcccatctcactacgtgcagtaacagcaataaccgggatagcacgtgcctgaggaatattggatgcacgcaataacttcagcaaatcgaacccgttaatggcaggcatctgaacgtcagtcagcaatacgtcaaatgaagaagtacgaagttgttctatcaactcgtccggctgctgacagcaagtagctcgaatattctgttgctcaagcatagccgcggtcagtgccaattgaatccggtcatcatcaatcaataaaacatgatttagcttttgggaggatatttcttctctatcaccagcctggtctgaaactgaggttgaaacaactgcctcctcctgcttctccccgacaacaggccctaccggatacagtggcaaaatgacaataaaacggcttccttcccccagcgtactttgcacgctaatcgagccttcaagtaacgtcacaagtttgtgaacgatagaaagtcccaacccaaatccttcctccccctgtgctccgggtaatcgggtaaactcctgaaaaatcttctcacgatcaccgggcgccattcctttacccgtatccgcaacctcaatgcggacactggatgaatggtaggtgacattcaatgcgatattgccctttactgtaaatttcacagcattcgaaagcaaattattcacaatttgccggatgcgtaaaggatcgctgataaaacgtccatccaactcagaatctatactgtagtccaaagctaagtgtttggcatcggtcagtggtttgaaacttacacgaatctcttcgaacagttgtgccggattgaatgtaacccggttgacttctgctttattcagatccaaccgatggaaatcaagcaaatcacttaccagtttaagcaaatgttgcgaagaacttttcatattgtccagatagaatcgttgcctttcgtccgttgtcaaccctgaaagcaaatccgtatatccgataatagaacccagaggagctttaaagtcatgagtaatggcaagcattaacttttcgcgggcctcaagtaacgcttctgcacgtttattggcctcttccaattctctacggtaacgattgctacgggtaatatcccgccagatcataatcaagaaacaagcagacaacaatacagcagcaacggcaattcctccgatagttcgagtggatctattgcgaagctcttgctgttcggacgcattatccacagcacgccgggtgactacctgttcataagttgtaatcatactgtctatgcgagtggtcagttccctgttcatccgacggaggcgagcattataattagggcgtactgccggctttgccttccgcttggttaccgtacgtatacgctgatgtaacgagtcaatcgggttataagattcaagaatagtgtccgtggcaaactctactgctgtattgaccaatacagcagtatcttcctttgaaggcacaaaaacctcaccaagcctcctaaaaaaacccttcttttttcgcttggtaataacagaatcgcgtttggtaatgatacggtgctgcacacgctgctgggtgatcaccgtatcctgctcggcaataatggaatccaactcaaccggagtaatcatgctttcattcgcttcattgatgatctgaagcatccggatggtattttcatccttttctttcaacagaagaagtaaactgtccgtctgtaaactttgtacatcatccgtatcagacaatttctccatctccctatgtacgaacaacagagagaacaataacacgaccagcaacaaagtataccccgccgcgatctttacttttgtgaaacgggaaggaatagccataacttatcttgttttatacctgaaacgtaaccataacatgattgccgcactacttagtccgaaagggaaagccatccagactccgaacaatccccaccccatgacaaaaccaaagaaatacccggccgggagagaaataataaaataggcaatgaaagcaatcagcatcataggctttacatccgaaatgccacgcagtgcattggcaaagttgatttgcattccgtctccaaactgataagccagaaaaggcaccatcagaacgactaccatcgctgacacttccgtattgtcagtaaaccatcctcccacctgatatcggaaaaagaaaacaatggataacaatacgattcccatagccaatatgatatgtgcgccggcataagccgtacgtcgcacattaacgatatcgttttgacctttgaaattgctgacccgtacagccactgccgctcccatcccatagaacatcataaaagtaaactgtgagatagtgagcatcacctgatgggaagccagagcaatagtgcccaaccatcctaccatcaccgtactcaaactaaatgaagcagtctccatccccatctgaaaagcgacaggccatcccaaagcatttaactgccgaaacaacgcgcgcgaccatcctaaacggataaatcccagtttataacgcaaaaaacgacggctaccaaaaaagaccaatacaaaaaccaacaccatgacaatgcgcgaaaacaatgtgctgatcccggctcccaatagtcccaactcaggaaatcccagtttaccattaatcagtatataatttcctacaatattcagcacattaccacccagaagtatccacatagctgtcttggtatcggttattccgtcagtaaactgtttgaatccgttaaataacagcacaaaaattaatgaagcaagcaatatcagatagtagggtttgatcagagagagcaattcttccggctgccctaacctttccacattcagataaagaatcgccataattccggttagcaaaatgcccaccaaaagattggcaagcaaactacaacgcaaagcttgtcctgcagcagcaaatttacgcacgccataaaaaccgccaacaatgggtgtaagcccatacgagaatccggtgctgaagatgatagccaacgtaaacatattattgacgaaggaagccgcccccagttcattggtactgtgatgcccaatcatcaaggtatcggcaaaaccaagtacaatcactcccacctgcccgatgacaataggaaggccaagaaaaaatagtgctttataatgattcttatatataagtctcattcctgctctcccttgctactcttatagtaaagtaccactccattttcttcacggaatgcggtttgtgccactgctttcagacggtcggcagttacagcacgataacgttctacttccttctccatatcttctgcttgtccgttcaactcaaaccatgcaagattcgtcgctacattcagataattgatatttccaaatatctgggtagactcaaatttattcttcactttctcaagttcatgttcctgtaccaaagcagtttgcaactcgttcaactcttcacgtacggctgcctcggcctcttccaatgatacaccggcagccggtttaccactgatatgaaacaaaccggcatcaatcgttcctgatatataggcatcaatactcgaaaacaattgtttttcttgtacaagatgctgattcaggcgactggaacgtccgttacttaaaatatccgataaaatatcaaatgcataataatcggcattcaaacggtcacacatgtgataagccataaaaagcgaatcaagcggtacatttcgctcgactacctggcggcgctctcctgtctggacaggctccttgggcaactgtcgtaaaggaacctcccgacggggaatggagccgaaccacttttccgtaagacttacggcctcttcaaatgatatatttccggtgacagcaagcacagcattattgggcgcataaaaacgaaaaaagaaatctttgacctcttccaatgttgcattggctatgtgggacaattctttaccaatggtaggccactgatagggatgaacccgatatgccaaagggcgcaacaaatgcccgacatcaccatatggctgattgagacagcgttgcttgaactcttccattaccactccacgttgcacttccaggctgcgctcactaaaatcaagactcagcatcctatcagattcaagccaaaatccagtttctacattctgccggggtacagtgagataatagttggtaatatcattattggtccaggcattattttctcctcccgctaattgaagcggtgcatcataatcgggtatattcaccgagcccccaaacatcagatgctcaaaaaggtgagcaaacccggtatgttccgggttttcatccctggctcccacattataaagaacgttgagtgcaaccatctgcgtgctggcatcctgtgagtgaaccagcctcaagccattgctcagaatatgcctgttgatctgcagcatatttattcgataacagaaacgttgataatcttcacatcttcttccggacggtcactgcggtccgtttttacctgctgaattttatcaacaacatccataccttctataacttctccaaaaactgtatattcaccatccaaatgcggagtacctccgacggtagtataagcttttatctgctcaggagtaaaatgaaaatccggttgtttggcagcttcagcctcagcctgtataaacaaagtatcttgtaaagcgaaaagtccatcctgatcgttagccttacgcattttatagatttccttcatatgtttctgtgccaaagcattaaaagcctcagtcactttattctgattcttctgctgttccatattcagaagagtcgaatcactgaacacttttccggtaacaatatagaactgacagccggatgactccttattaggatttacctcatcgccctgacgagcagcagacaaggcacctttcttatggaaatatttaggatatacaaactctgccggaactgtatagccgacatcacccgaacctaacatcttacccttcggagcatttttcgattccggatcaccggcttgcaccataaagtcttttattacgcgatgaaacagcgtcccattatatgttccgtcttcagccaatttaataaaattatctctgtgttttggagtctcattatacaatttcactttgatatctcctaaagaggtctcaattttcaatacagtttctttttccatgtttccatttttcttttgtcccggtttacaagctactgcaccgcaaaccagtataattaataatatccaaaaattctttctcataacgcttttatttaatttaagtctgcaaatatacgactttacctcaaaacctcttacctttgtagctcacaaaaagaggcaaaagctaacatcatgagatccatactgatagttgaagatgatattacgttcggaatgatgctaaaaacctggttaggcaaaaaagggtttaatgtatcatcggtaagtaacattgcacgtgcgcaaaagcacatcgatgcacaaccgacagatctgattctttccgacttacgacttcccgaccacgatggcatccatctattgaaatggatgggtgagaaagaacttcatatcccattgattatcatgacaggatatgcagacatccaatcagcagtacaagccatgaaattgggtgcgcaagattatattgccaaaccggttaatcctgaagagctactcaaaaaaataactgaagcccttcaagttaaagaatcccctcttccacaggtagccccacatggtaaaagtcccaaaaccaaacaggaatcccattcctatctggagggagaaagcgatgcagccaaacaactttataattatgtcagcctggtagctcccactaacatgtcagtcctgatcaacggtgccagcggaaccggtaaggaatatgtagctcaccgtattcatcagttaagcaaacgttgcgacaaaccgtttatcgctatcgattgtggctccatccccaaggaattggctgcttctgagtttttcggacacatcaaaggctcttttaccggagcactctctgacaaaaccggtgcatttgtagcagcaaacggaggtaccatttttcttgatgaaataggtaacctcagctacgaaatacaaattcaacttcttcgtgcattacaggaacgtaaaatacgtcctgttggttcaaatacagaaataacagtcgatatccgtctggtatctgcaaccaatgagaatttggaacaagctatcgaaaaaggaacattccgtgaagatctatatcatcggattaatgaattcactttgcgaatgcctacgctgaaagaacgtggagaagatatccttctttttgccaacttcttcctcgaccaagctaataaagaacttgacaagcaacttatcggcttcgatgccaacgcttcaaaagcacttcttgaatatcactggcccggcaacctgagacagatgaagaatataatcaaacgtgccacactgctcgcacaaggtagttttattggtctcacagaactgggaaatgagatacaggagacgcaaccctcaactcccaaaatggcattgcgggatgaagataccgaaaaagagcatataatggaggcgttgcgacagacaggcaacaataaaagtcgcgccgcgcaattacttgacattgaccgcaaaacattatataataaattgaaactatacggaatcgatctttaacgaacagcaaggtgtggaatatttccacaccccattccacactttccacagtgttctacactatccttcatctttatctttcttttagcatactgcaaatcaaccggttacatcaggccttcctttctggcacagcatttgggaaatactctgtacaagtgtttaaccaaatgaaaataaaactaaggagttagttttatagtagtagcaatgtttatgtttgtttgtgatggtttttaacctagaccttaacatgaaattaaaaaaacagacaatcaaaacttttaaaaagcaataattatgaaaaagttagttttagtagtagctatgtttatgtttgcttgtggatcattctttgccatggcacaggatccggtgaaaaaagatcaaaagaaagaggtcaaagacactgtgaaaaccgaacctaaaaaagaagtagctgatacaactgctacaacggtcgcagcaccaggagcatttgcacagtttgccgaataatagtaagcacactacaacaaaaaagccattcctacttcgtctattcaaggaatggcttttttgctatatatctatttcaaacccatgccacaaattactatccggcacaggagcatcgagttctatcaattctttggataccggatgaacaaaacgtacatacctggcatgcagacagatacttccatccggattggaacgtggagaaccatacttcaaatcacctttaatagggcatcccatctttgccagttggcaacgaatctgatgatgacgtccggtcttaaggtcgacctcaagcaggaagtaattatccgaacggccgataagcttatagctcagaattgctttcttactattgggaacctccttatcataagcatagctcttattctgtttttcgttacgtaccagataatgtatcagttcaccttcaggttgcctcgggcaatttttcacaacagcccaataggtctttctgacctcactgttcttgaacatctcattcagccgggataaggccttactggttttcgcaaaaataacaagaccgctcacggggcggtccagccgatgggttacaccgataaagacatttccgggcttctgatatttatctttcagatattgcttaactgtttctgaaagaggagtatcacccgttttgtctccctgaacgatttcggaagcggtcttgttaactactataatatgattgtcttcgtatacgacggtcataccgaatattacatattcataccaccatcaacctggatcacttgtcctgatacataagaagacatatcagaagcaaggaaagtagccacattggccacatcttcaggagtaccgccacggcgcaatggaattttcttagcccattcagttttcacttcttccgaaaggccggctgtcatatcagtgattataaatccgggagcaatggcattggcacgaataccacgagagccaagctcctgtgcgatagatttagccaaaccaatcataccggcttttgaagctgaatagttagattgtcccgcattaccatgaactcctaccactgacgccatgttaataatgcttcctgctttctgacgcatcataatcggtgtacaagcatggacaaagttgaaagcagatttcaggtttacgttgataaccatatcccactgctgttcactcatacgcatcatcaatccgtcacgagtaatgcctgcattgttaaccagaatatcaatacgtccaaaatctttatgaatctcttctaccacctttgcagtatcttcaaaattggcagcattcgaagcatatcctttagcttttacacccattgcctcgatttctctcgctgtgttctgtgcattttcgtcgataacaagatctgtaaatgcgatatttgctccttcagaagcgaacttcaaagcaatagctttaccaataccacgagccgcaccggtcacaatggctgtttttccatctaataatcccatactaaatttaaattattgattaatttttgttctatgtagtgcaccaaacacgatgttggcaacatatctttttcgggtttccatatccaggttcgccccgatatgtcctcgaatatatggcacctcgatgccttttacgcagtaatgtaccaacgcagcggtcatttccacatcgtctatatggaacacccctttgtcttgtccttccttcagcacacttttgaaaagttgcatttcttttgcatcaaaccttttgcggactttctccacccgccaaatatctctgaagaagttggcacggagtgttccgttacgataaaccacctcttttactgcatccagtcgcgtgtagatcatctctataatttttttatcaggagagatatctttatctgccacacgcttcatcatatccgacaaaatatccagttcagactctacaacagccaaatagatttcatccttacttttaaaataggtatagagcgtacgcctaccctttttagaagcaagagcgatatcattcattgtagtattctccacgcccatcttggcgaagagctgacgggcaacgtctactaacttggcttttgtttttgatacggtcataggttaattgcacattgctgaattatttgtgcaaaagtaattcttttctttcgtccacacaagaaaataaataaattattaacaattgtacctgaaagcactatgaaaaaaagtaaaacaggtcatcgctgatttccagcaacatagcataaaaacaacatttttatcgaaaaataaatatcgaaatatttggtagttcaaataaaagccgtacctttgcactcacaaaacagaaacatcgcggagtggagcagttggtagctcgttgggctcataacccaaaggtcgtctgttcgagtcaggcctccgcaactaaatagaagagaaaggctgataattaataaattatcagcctttcttgattttatatcagaaccaaagggatcatggattaccgttttatcattaagtaccaactttaagacagtcaccaatagctacattattcttagtaccatccccggatcagaacaatctccctcagaagcattcatgagtcctatttgtcggattacatcccccagtattgtcaaacgattccccttgattacaattttggaagtaatatccaccggagtttctcctgccaaatcctgtgcatataccgtacgattctccttttctattgagaaaggaaataccatcgtcacctctttgaaataccccagtaaaccgacaggcacatcccaacgatcaatagatacggtcactgcaacttcttctgttacatattcacgccccaaattacgccctattgtaacaacagctacagcaccattgggataacgggacgccagcacaaatggacgaacttccagaggagccccggaaacttccggcaatcccattccccgggcgacccgtgccggtgcttcagctatcacgtccgtaccaaccttacgtcctttattccaggtttcgttctcccatagcgtccaatgatcagtaagcttcacgctatcaatagcataagttgtatttcctacagagaaaggttctgctatccgatgccatctgactccacgtactacttcatccaaacgtcgctttatatcacgcccggtcggtggaaatacaaaatcctgtgtcccatccggcaaagttcctgcaaacgaatgacgcatcacaccaatagcacaacccagccccactgcaatataaggttcatcttcacagttgataattccttttgccccattaacggtcttataaggtaatagatcacaaatacgctgaatagtaatcggctgcgccataatgttttctacatcatacgtccgaaagacatcgctgaattcaataaactcatttcgcaaagcatgttctatatataaatgaggagcataccgtttgcccatagaagttaatcttctcctccattctccattcctatcctctttcccccaatccactttccaataatcaaaacctgcttcattagctacctttatcctccgtttccaatattcttcctcaggaatatcggcatacttttctgccttctgggcacaaatccatccaccaacacctttccagcctttgcctttgatttttaaggatagctgccttaaacgttccacgtcatctccaccaaaagacgggaagcgatccggactaagttctacagttcctaaataaggatttggtgaatcattaacgcctttcggtatatcccatgaatcgtccattacaaaataaagatctttccggatagcaggataacaatctacccaattctgataggatccatctccaaataaatagtcttcagtcatggcggctctggttagttcagtacttttatagctgaccacatagccttgcaaattccacgtacaaaagtaatccggagctttagatggagtatcgggcacaaggctttttactgcacatggctgacctgcaacagaaatacacatgctacaaaaaaacaatatcaataagtttttatgtcgtgtcatataggatattttttagattaacaaaaacaaatattgcaaatataatcattcttctcatctatcggacaagatcatttcattcgtttcattaaatctctccaaaacggcaaaatactccaatgccttaccactccaaaaacacgccattactatcgcatttagccccataatagtctactgcataaatggtaagtatgtaacagaaagtatagctttccacttctgataacaaaaaaagatgcaacaataaactaaacagttcttttgctacatccttttcttcctgatatacaatctatccactcaaacttctcaaagcccgagaagcaatgccttttttattcgtcttgaagtactaaacaccctttttccttcatcgtcacatgcagcacggcatcctccttcttaggagtccaaatcatcttcttgcattcccctttctggagctcattacgatgataagtctcactacctgtcaagtgttcagtaccaattgtacattcatggacaccccagtttctgacgccatccagatccaaataaagatagggaattatcgattgaagagcattaaatgtcacgccatcaccatcaacatagagagcgcgaatctcacaagaatctaaacgtacttccccactttggatatacgtagccaaagagtctgtttttatcccgttcatattcgtacgcaatccacgaatggtattggtcagaaaagccagattagcatccgcttctatagtaagctgtaatcctttagcctgcaaccccggaataaaatatttctttttctgttcaggaagatcataattagtcaaatccaggcaaatcaccaaagtatccgcatcctgactgattttcagatattcagattccggactaaataatcttgttttcccatcagtagatggcactacattcacgcaagcctgttccagccatgcatgacgtgtatcacttgcataaacttttacggcacgaacaccggaaaactctgtttgaagcaacttatccgaaaaagtgagtatgtatgagtctctatcagacttttggaaagaaatataaacgacacctgccattagtatcacgagtaccgaagcaagtatgccaataaatatatatgtagtacgtttcataagattctatttttttatttttgtttcatcataaagttacgatacataaccagcagctcttcatccgaaactcccagtgtgtagagttgacgaaatacgtgctcaagttcatccttcaagaaggtctcccggcgaagtgaaagaatcagatctttggcaccggcagaaacaaaataaccgatacctcgtttattgtaaatgatattctgcgactgaagatagtcgaacgagcgcatggccgtattggcatttacctctactatagctgcatactcccttacggaaggaatacgttcctcctcctgatactgcccgagaagtatctcatcacagattcgatctgctatttgcagataaatggctttactctctttaaaattcataaacgtaagagtttgttacattcgattaataatctcagattccttgaaacggaaatacgaaagtgtccaattgatcagtgtaaaaagtattgctattgctgaaagacaatcaaaagctgcttcctcactaatatccggattgaaatttatgtgatccgaccatatcaatttagcaaatccgccaacaattaacacataggcaataaaaacaatcattcctgcagaaaatgttttgacaaaagaattcttaggccagacagtactccctaatacaaaacaagactgaaagaaaaaatagcctgctatcatcaatacaaacgtataggtatgcctgaacaccgtataataacctgtattatcaccaaacaaatgagacagcggagtaaccgcaatcgcatcattctccggataagctaacgaatacaccaatacctttgtataatccgccagcttataggtaatcagaaaaacgattaagaaaacaaccgtaaataccagccagcgggaaaagaatttttcaaacgaagtggcaggagtcataagtacagagagccgccctgttttcgatttcatcctttccatcgtaaacgaagcactcaggcaaccaaacacccaaagcccccatataaaaatcatcagattaaaactccaggttatatcgctatcctgactggcccgataactcaaatatccattccatatcattatcaccgccatggcaccatacatcaacgcgacacggagcagatttgacttccagttctcgatcatctctttacggcagagattcataaaacgtgtttggctgaaaaaagtatctcttatcataattctgtttgtttagtgtggaacaatgcagatatcctttcgggaactgccaaggtagcgttaaaaagtaattcaagattgatctccgaatcatcgcccgattcattaggcagaagcaagaaattaccttgaatagacggagcggaatataaagaagattgaagcaatgtccggtcgtcactctcagtaaaaagcagtttatcacaaatgcccattacagattcgttcagtagcacccggctattgtccataatcagcacatggtccaacaccttatcaatgtcacgcacctgatgtgtagaaatcaagatcgttttatcatctgtcatacccgaagctataaacttccggaactggctcttacccggaatgtccagtccattggtcggctcatccatcaatagtaaagacgtatttgtagcaagcgcaaagctcatgaacactttcttcttctgccccatagaaagcgcccccagatcaatattgatatccatctcaaaatagtgcagatatttcaccatatcctctttactgaaacgagggtaaaacggactgtttaactctacatagctaattagcgaaacagggggaaggtcaaactcttcaggaaccaggaacatatcctgcaatgtaaccggcaggcgacggcgcacatcagtaccgtgataaagcacacggccacttttgggtgtgagtaggccactcatgagatagagtagtgtagatttacctgcaccatttttgccgagcaatccgtaaactctacccttctcaagtgatagagagaagtcatgcaatacggcacgcttcgatttacgatagaaaaaagaaagattttctgctgtaatcatcttcatttatttatgagtttatgcgtattagtataatagtacactacaaaagtaggcaaatatatggatactacaacaaattcagcaatattttttcaaactttcttatacaattcttataatcaacactataaagaaacacattttatatatacaaagaagagaataagatcaacgcaaaaactgagaagcatatgtctcactaaatataataaggtgaaaaacaagcagacttataattaagcaaaggtagcggaaagcactataaaaaaggaggagctaagaatcactctccactcctcccacacgacaaacaactaaaattattactatttgatgccatccaatgcacgtttagcagtagcattagcggggtctatagccagaattttattccaatactccttagattcaggaagtttgttagccaccagataataatatcccagataactgtaacactcaatcagtgcagagttatatctcggatcgtttttgtcaaccaggaatgtggctacctcttcataataaggtttagccaatccctgagtggtttccgggtctaacgcagaattggtgcgtgccctccagaagttacccaaataactatccggagccactgtagcaatttcagtaaaaatagaatcggcagagaaaagagcagccctccgctcatctaaaggaaccgtcaatgtatccgattgcgtacccttttcgtaataaagctttccaatctggaactgtacgtcaggggtacgtttatcggcactcaacgattcgctatattttttataggtttctatcgcctttgtaaattcattgttcaattcataagaagaagagacttcacgccacaaatctgttttactcggatcgagtgtgattgcctgcatataagcatccaccgcttgatcatacttttttacagcattaagcaaatgaccgaaatacatatagtcaagataagaaaaatcggccttatcagactctttaaagaaagcatctgctactttcatagcttcatcatagcgtttcaagtcggtatagttatacatagccaaacggttgaacgcggcatcacgcggattcttctgcaatcccatcagagctatctgtagcgacttctcaaaatcatggttcaaaaaaagcgcaaaagagtacttcgtcaaatcatcttccgttgcttccggagtattgatgaatcgggcataagcttcagccgctttatcaaacttattattcaaataataaatttcagccaatttcttgtcggcagcaacactcgaaggatcaatgctcttcagctgttccagtttctctatggcaagttgtggactggcagccttatacacatcagcgaatttcaaataggcctctttataattaggatcgaaatagatagcctgttcgtaaagctgacaagcttttccggcctctttcttagctacggctatatcgccttgcagcaccgataccgcagccgatttgctgtcagccttttgtccaagagcggcataagtttccgcttcactaattttaccagcttccagatatgcctgaccaatggcagtcaggagatcggtattttttttatttttccctttcagcaactgtgcggcttcttcggaagcctgcgccgggttggtctgaatcaattcttttactttggcaacctcgctgtgccaatcagcatccgccgattgcgcaaaaagcggaccggctgctacaaatgctcctactaaaaacagttgaaatcgtttcattgtaattcaattttagttattattcgtctttcacgtccacaatacgaaccggctgggtagccggaacgagtccggactttaatataatccgctgccctctatcagaagtgagaaaagaagcgaatccccagggcagtgcattacggggatcattcagtaatacataaatagggcgtgctaacggatagtttccgtaatacagataagcttgatagggcttgtaactgttctgcggggtagctatatcgtctgcacttactgacatcactctaatctcatcacggaaagacaagtttgtggtatcactccagtttccaagccaattgacgccaatcactccgatagcatcgggtgtacgtgctacgtaatcaatcacttgctgatttgtcctcagagcctttacatctttatcggataaaggagctcctttgcagatggagtcaactgcaaaacgtaccgtgcttgagttcttattatcaaatacgagttggatatcacccagctttgaggtaggataaagctctttccatgcatgtacccttcctgtcagaatacgccggatatcacgcaccgaaatcagggtatctgtattttgcctgttgacaatcagggctaatccgtcagtagccagctttatttcccgagggaagaatttccggctgtggaaagaattcatctcttcgggagtcaatgtacgagtggtaatagccagacgcacactatccttcagaagctgattgatagcgtctacctcagtagtataacggggaacaattccggccaaaggaaataatccctcgaatacatcgatttcctcttgaacaatgggttgaaaactttcgtcagcggtaatagctattactcccgacgtataagtatccgtcagtccgtccttgggttttgaattacaagcagataatacaatcaaagaccaggcactgattagccagaattgtttcttagtcataattactgtagtttaaagacaataggaactgtgaaatttactgccacggccttaccgttctgttttccgggaatccatttaggcatcgatttgataacacgtatggcttccttgtcgcaatatggatccaatgaacgtgcgatagttacatcccgcacctgtccatccttaccaaccacaaaacgacagatcacctttccttgtgtaccattctcggcagcaatggtagggtatttcagatgttcaccgatatacctcatcaattctgtggttccaccggggaatgtaggcatctgttctaccatatcgaaaactttttcttcggccggctctgcctgagtaaccacttgtttcaaatcggcaatatccttaccgtttgcttcatcgttacccttcacgtcggcaatggatatagcgactttggtttgtgtgagttcttcctggcttttaatctcatcatcctcatgtacctcctcatcttttttaatgactggagcggtaaacttgatagaactcttcaaagcaggtgggggtggtgccaccggttctactctcttcatctcttcctgctttatttcaggctcctccaattgcgacaaggtggtgacttccgtcattacctctttttgcttcggagtggccattttgattaaagtcggaagactaaaacccactaaggcgattatcaacacaataaccattgccacattgtgacgtttgggtgaatcagcacgcattttatacgcaccataagctttatttttgcctttaaaaatcagctcacaccattcaaaagaagttaaatctatttttgccattttaattttctattttttggtgttacattttattcggcaatattctgtgaaagctcacccttactttcaaaattcttcaccagaaattcgtcagcctcggcaatatccgttatcacatacttaccaatattacatatctgcatttcatcgagagcgtcaatcagatttgcatacgatgcattatccatcgccttgatgatgactgtgggcgtatcctttccactctttatttcggaaagttgcttcgtaaattcatcgtctgatatcttaagttccagcttcttctgtttcagatcatttacctgtctgacagcagcagcattcttcttcagaagtattgcccgtaatccatccggtttatacgacgtctctttcagagaagtataatccttgtagttgggttctccttcataataatatagtttgtcatcgggtcccaacaagagcgtgattgcctgtgaagctttcaccttgctttgctgttcttcggtgatgtttttatcattgctcggcatgcttatctccatcgtctgaggtttgctcaacgaggtacaaagcataaagaaagtgatcaacaacatattcatatccaccataggcgtaaagtctacgcgaaccgtcatcttcttctgtttgctattccccttctttttaccgctttcttgtacttcagcactcatagttgttcgtttttagttttcagaagtcgttttcagagaagtaatcaggttataccgattctccctgaggtcctgaagtgaattcataacatttttaatcacagaataaggagtatccgcatcagccttgatcgcaatacgcaaatcagaattcacagcacgtgcattacgcacccatgacttaaactgattatcaagactatcgcaaggaataccttcgttcttcagtactgcatcctgcttatcagtcggcaagtcaagataagttttcatgtttttcatcggcactccgaaagtggatgccaacatgaatttcttttcctgttccggagtgaatgtgacgccatattcctgtcccatgctctccaataccgctttcaagtcggactgcttgtccatactcataaatatctttccgttcggatcgaccaatatctgaaggatattcttttccggaatcttaatttccgaaactgaggcgggtgtagtcacttgtaccggctctttcttcacaaatgtagaagttaacataaagaaggtaagcaacagtaccgtaacgtcactcatcgccgtcatgtcgatgaacgtacttttctttttaattttcgctctgcccattattgtcagaatttagtggattccagattatttatgagtagctgcaaaagtctgcacaatagagaagcctacctcgtcaaggctgtaagtcaacttatcgattttgtttgtatagtagttataagagataactgccaacgcaccggtaaggataccgaaagctgtattaatcaaagcttcagagataccttgtgaaagagccattgagtcggcagaaccaccggcagccaaagcggcgaacgaacggatcataccaataaccgtaccaagcaatcccatcaaagtacccaatgtggtgatcgtaccgataatcggaagattctgttccatcatcggaagttcaagcgcagtagcttcttccagttctttttggatagcaagcagtttctgatctttcgaaagagaagaatcattctccatttcttcatacttccgcaatgtagaagtaacgacgtttgctacagaaccacgctgtttgtcacaaacttcctgcgccttacgaagatctcctgccgatagggcatccttgatgttagaaacgaatttaaccaaagaacctctaccgaaagcagagcgaagagcaaaataacgttcaatgctcaatgccaatacggtcagcaataaagtttgaataacaggcacaatcactccacctttgtaaatggtccccataaagtttcccggaagtgggtgattgttaggatcattgttcataaagttcgtgggatttcccaaaatgaaatgatagatacacactgctataatgaaacagcagataataaccaatccggcattcttgatacctacaatcttagtcgactttttttgagtagtttccataataaagttttttttgttaaagaatttgttattaagaattaaagtaaatacgattagacacaccgcagtccgacccctacagcctcatgctaaaaatgaggctgcattgtcaaacacagcgagtatataagattgggaattaaataaggatacgtcttaaagcaaagatgtagtattgacagcttatggacgcataatgtggatccttatccgaataataagatttactttggtctaataccaacaaattctctctcaacaggcacaatttacgcattgtgtcattaaaaaggtcagaatcctcaagaattcgacgaagacgaagattattagtagaagaatatgtttcagaaacgggtttgaaacctaattcaacatcggagacagacaaagtttgcgatttatcaaaaccggcaaaatcgctaccacaccgataagagtaattagcatccaaagaagaggatgaaacctggcaagaagtaaccgggttatgagagcattccataatattcaatgcattgccacttatgctaaatgatagcatcagtagaataaacatcaatatgaattttacagaagttttcatcgttctatttttatggataaactctcttttcgattttcgtggcaaaaatagtaacttattgtatagtgtcaccatatttcacatcttttaattgctaaaaatcgaactctaccattaaaacactcacagccggtttttgttttaactaaaagattctttcttttatataaaagattaatcaaagtaaaaaaggtataatgcaaataagtgatccccgcttctccaagcgcatgtccctcttagcctataccccaaaaacaagcatcccctcgtgtcttctgacccgaggggatgaactctctgaaaaaaacggcgacgtcccgccgtaacaatgaagtttaccgcttgaccacaacattgtataattccggtgtcaaaggttccacggttgaagaacaggcctctgtctgtctcgctctcctaatgggttacaacgcatcgttcattgaccacggagaaaagcgcaaacatgtccagaagatattagatcgttgctgggatatcctcgatactcttcccgcttcactattgaagcttcgtctgcttaccgcctgctatggtgaggtattcgacgagcctttggctgacgaagcccgtgcaattatcgcttcttgggattcggtgtcacttactactgaacagcaagaggctatcaacgagtttcagactgtggtggataatccttatccgtgggagtatgttgaagaataaatttggatgcttacttgttgaatagtaaagtcacttattggctgagccctcgctggtaatgatttatctatataataaactttgttactttactattaaaatttaacattatgggtgaacaatggtttgtatttacttctcttgagaatccacaagaggcgaaaacggcttctctgtatcttgattatctgacttggaatactaagggccgttggacggcggagtacaaaaatggcaagttctatcattgtgaaaatggtactaaggacaaatgtcatacagactccatcctgaattatatttcagatacgggtgagaactggcagatgaagattgaaggcgatcattttgtccatgctctcaatggagactatttacgtgcgcatatagacacggtaatgcattatattggttgggatgggcgtaagtggcgtgctgaacttctgactttgattgacggacttcattcggatctgaatggtgatgaaccgttggtttatccggaaggcatgcttctcaaaactgatgttgccgatgaggtttatctggttcaattgggtagtcatcatcacattcccaatcctgatgtttattttactttatttcctgcttgggataagatcacggtgaaaagtcaggaggaagtgaatgcgatacctttgggtattcctctctctttggatgcctgcctgattaaagccaatgactctgatccggtgtatctgagtacgaacggtgtgaaaagtcatattaaatcggtagaagattttaataaggtcggtttcgattgggataaaatcaaggtgatgtctccggcagaagtggatgcaatccctactgctccggagtatgagattgctaattggtaatccattcggttggaactaaaatcataagggggaggatatttccttcccccttttgaggattctcgtaaccactcgaaaaagggcttagaattttaattttacctttgttagaaacattatggtttcggacaaacttactttggcaactagctaatgttaatctcaaaattattttttaacacaactcggtttaggataccgcttggtgtcttaattaaggggtatgtcctaaattgagtgcttacaatatatagatacaatgaatgttttagtaacaggtggagccggctttataggatctaatctttgtgaggctttactcgagagaggtgatgtagtaacttgtttggataatttttctacggggcatattgagaatttgttgcctttgatggataaatattctaaaacttttaagttaatcgttggtgatattcgatgtttggaagattgtcgtaaggcaattatgggaaatcaatatgttttgcatgaagcggctttaggttctgttcctcgttctataaatgaccctataactactaatgaagttaatatttctggatttctaaatatgttaattgcagctagggatgctggggtaaagcgttttgtgtatgctgccagttcatcaacttatggcgatagtaaaagtttacctaaggtggaaggtgtcattggtaggccgctttctccttacgctattactaaatatgtaaatgaactttatgcagatgtttttgccaaaacttatcatatggaattaataggattacgttatttcaatgtttttggtaagcgccaagatcctaatggtgcttatgcagctgttattcctttgtttgttaagaaacttataaatcatgaaacacctaatataaatggagatggggaatatagtcgtgattttacctatataaaaaatgtaattcaaatgaatctgttggcgttagaaacaattaatccattggctattaatcaagtgtataatactgcttatggtgaacgtactactcttaatcaattaattgataatttgaaagaatttctgggggaatttgatcctgcaattcaggagattgagccaactcatggtcccaatagagtaggggatattcctcactcattagcttgtatagataaagctcgaaaccttctgaggtacgagcctcaatattcgatgaaggaaggattgcgagaagctgttgattggtattgggagaatttgaaataagtaaaagatagtttaatcatttaatatgaacactaaaatttgtgtaataggattgggatatgtgggcttgcctttggccagattattttcaacaaagtataaaacggtcggttttgatatgaatcagaatagggttgaagagttgatggccggacatgacgctacattagaggtgagtgatgaattgctacaatctgctattctcaatgggcttaagtgtactgcaaatattgatgatattaaggattgcaatttttatgtggttgctgttcctacccctgttgatgagaataataatccggatttgagtccgttgattggagcaagcactactgttggtaaagtcatttcaaaaggggatattgttgtttatgaatcaacagtatatcctggagttacggaagaaagctgtatacctattgtagaaaagacctcaggtctaaaatttaacttagatttttttgctgggtattctcctgagcgtattaatccgggtgataagttacatacagtagaacatattaagaaagtgacttcagggtcaactccagagataggtcttaaggtaaatgaaatatatgcctctgttattgcagcaggtacccatttagctcctagcatcaaggtagcagaggcggctaaggtaatagaaaattcgcaacgtgatattaatattgcatttgtaaatgaactgtctaagatatttaataaaatggatattgatacacttgatgtattagaagcagctggtactaaatggaattttttgaatttccgtcccggtttagttggtggtcattgtattggcgtagatccatactacttagcccaatgtgctcagcgttatggttataatcctgagattatcttggcaggtcgacgtatgaatgatagtatgggagaatatatagcaaatgaaaccgttaaattaatgttgaagaaaggaatacaggttttaaattctgaacttttgattttaggttttacatttaaagaaaattgtccggatgtacgtaatacgaaagttgtagatatttataggactttaaaagagtataatattcaaataacggtatatgatccttgggtaaatccagatgtcgctaagtatgaatatggcattgaagtaataaaaacgttgccagatcataattttgatgccattgtactgtctgttgctcataatgtgtttcaagatttggatatttcttctttattaaaagaaaatcatgtcatttttgatgtgaaatgtatacttgataaaacacaagttgacggaagattataatgaaaatagcttttcatcatcgtccgggttcatttagtgatcgctggattgaatattgcaaagacaatcaaattgcttacaaactggttaatgcttatgatagtgatataatacaacaggttgctgattgtgacgcttttatgtggcatcatagtcatgtggattatcgtgatactctttttgctaaacaattgctttattctttgcaactttctggaaaaaaagtatttccggattttgtgacaggctggcattttgatgataaagtgggacagaaatatctttttgaagccattaaggcacctttagttcaatcgtatgtgttttatacgaaggaagaggctttagagtgggctaaaagtactattttccctaaagtgtttaagctccgtggaggggctggagcagcaaatgtgaagttaatacgtacaaaacgagatgccatccgactaattcataaggcttttggtaaaggatttcagcagtttgatagatggggatattttagggaacgttatcgacgatggaggacaggagaagattcttttgtcggagtggttaaaggattagctcgtttggttatttctactgaattttcaaaatttcattctccggaaaagggatatatatatattcaggactttgtacccaataatgatactgatacacgtatagtagtagttggtgacaaaattataggtgaaagaagaggggttcgggagggagattttagagcatccggatcacatatccttctgcctgatcataagtctgttgacgtaagatgtgttgatattgcttataaaatttccaaatgtatgaatttacagattggggtttttgattttattcataatgataaaaatgaaccgttgattgttgaagtcagctatggaacagatcctgactatacagaatgcgaaggttattggaatccaaaattggaatttacttcatgtaagatagatttaccttgtttggtgatgttgaattttttgaaacagtagtagctatttttatacactgaaaaagtgtctaaatggggcgtggccttaaattgagtactaaccaaaattggacgctaacgttaattttaaaattaaatttttaactaacttggtttagggcactgtttagtgtctttattaagggggatgccctaaattgagtacttacaatatagtggagtgaacaaattaaaacattatcaatctgcaatacaatatcgtttatatgcatatataaatgaacatagaggatatgtgactgataggaaaatagtagttatagaatcggatgattgggggagtattcgaatgccttcgatagatgtgttccatcaaatggctgcactgggtctggatactgtcggaagatgctataatgagaatgactctttagctacaaaacaagatttatcttgtttgtttgatatattgtcaagttataaagattctaatggacattttgctaagataactgcaaatacttgtgtagctaatcctgattttgagaagataaaaaggtctaactttagttcgtatttttatgaaccttttacgatgactcttgaacgttatcctaattgttcctttgacagctggaaagaaggaatcacacaacatctttttattcctcagtttcatggcaaagaacatctaaatgtggaaaagtggatgtttgagttgcaaaatataaattctgaactaagaacttgttttgaatttcagacatggggaattcgatataacaattgtcaagattctgttcttgaggcatttttagtttgttctgataattcaataaaattgcaaaaacaagttttaaaggaagggatgcaattatttcaagatatatttggatatacttcaaaatcttttatagcgccttgttatacttggaatccagatttgaatcaaactttaaaacagattggcgtggagtttttgcaaggtggatattctcaatatctttctgatataaatggttcgagtaattctttatatcattatatgggagaaaaaaatgattatgaacagatttatttagtacgcaactgtttttttgagcctactcaggatgctcgtttagataaggatttttgtttaaaaggtattgctaaagcttttcgtttaaaaaaacctgcaattattagtgcacatagattaaattttataggatcaatacgtcctcaaaacagagagcgtaatttgagacagttttcagaactactaaaaacaatattgaaactttggccagatgttgagtttatgagttcagatgaattgggtgaggttattcgaaataataaaataaaataatattatgtcaaagattgcgattattggtggagggatctcgggtctctccatggctaatttgctgcaaaaaagtaatcatgttacagtatttgaaagagattctaaacctggtggtttgataaaatgtgaagttgttaatggaaatttatatcatacggtaggtggccatgtctttaattcgaaacggaaagatgtgttaaattggttttggtctttttttgattgtaaaaaggactttgtttctgccattcgtaatgccaccatttcaatgcctgagtatggaaatattggctatccgatagagaatcatttgtatcagttacccaaagaggtaagtagtagtatcattaaggagttagtagaaagaaggaagattccaaaaatgaatttgaataactttgaaatgtttttgcaaggccaatttggaacgatattatatgagatgtatttccgttcttataatgagaaaatatggaaaaaaccattaaataaaataccgttatcatggcttgaagataaactgccaatgcccacagtggaggatattatactaaataatatttatagagtagaggaacaaaagatggtacatagctcttttttttatgctaagaaaaatggatcccaatttttagcagatgtattggctaagcatatagtcgttaaatataatacagaagtaatgagccttgagaaagataaaggtaaatggattgtaaatggtgaatgttttgataaaattattttttgtggaaatataaaacagttaccagctttggttaataattcatttgaacttactgatgaaatgcgtttggctatcaaggatttagaatatcatgggactacctctgttttttgcaaaatagataagaatccatatagttggatatatatgccaaatagagaatatctgtcgcaccgtattatttgtacaggtaacttttctcaatttaataatgttgatagagaaagtctaacagcaacagtggaatttacagattatctagcagagaatgaaatcagagaaaatttattaaaaattccatataatccacaatatattacacataaatatacagagtatacttatcctattcagacagataagaccagagaaatgataaacagcttgaaaagaattttgaaattgcaaaatatttatttactgggtcgattcgccgaatgggaatattataatatggatgcggctattggggcagctatagacctttacaataataattttagaaactagttttttatcatttgaaataatgaaatgtagtaataaatctgttgtttatgtttctacatcaccgttcccaaatggttttgctgcgactaatcatattatttttcatgcaaggggactccttgctgccggagttaattgcgaatgcattactgtaaataggaccgagtctttggagaatataaaaaatgatactgcgacaggaaatcataaaggaatttctttttcttacatagggaagaaaacaattagagctaagaatcgctataaagctaaattatatgatctgattgatggtctattaactgttgctttttgtttcaaaaaagctcgtaaaaatgtatcatttataatttttggaccttcttttcttttgtctttaggatgtattatagctgtaaaaatgaaaaaaggaaagatttatgttgaattaggagagcacccatacgctgtatctcgtagtaaaatggaatttataagtagtttcttggaaatccatttattataccgtctttattctggatttattggtatttctgaaaatctaattgattttgcaaaaagatatgcttcaaagaaagctcgttttataaaaataccaataatgttggatgcagagctatttgacactagtaaaaaagtagacaagaaactctatatttataatgcaggaagcaattctgaaaataaagatggtatgattagtacattaaccgcttttggtgaggctctaccttttattgataaaaatattgatttttatttgtcagggccaaagtcacctgtacatgatgatttaattggaatcattgaaaaatataagatgcaagatagggtacatattttaggtgtaatttcttatgaagaagttattaaataccaagaggaagctgcactagctattattaacaaaaatgataatttgcagaatagatattgctttgcgacgaaaatgggtaatatctttgccagtgaaacagctgtgataacaactactgtaggtgaggctaacaattacttgaaagatgggattaatgcttatattgtggaacctcataatcctttgcttattcgtgacaaaattattcaagcttttaaaaatccggatgaaagaaccagaatcgcgaaagcgggcaagcaaatggcattcaaagaatttgattatctttatcatgggaaaagactcgctgtctttttgtgtaatggcaatgattaagtaatgaaagagctactaacaaatttttttgcttacggatttgctatttcacttgacaagctattagcgtttttacttattccaatatatgcaagcaaactttcggtagatgagtttggtgtcattgatctgatacaaacaattattggaattgtttctatatttgcttttttacaattagaaacctctttgcaacgctattattttgaatatgaaggggaaaagaaaaaggagtatgtgtttacaatatatatttctgtgattatattatctattcttttgtctgttttaataggtttattttcacgtattttagcgacacatatttgtggtgatgcaaattatttcaaatatttgattattgctgccattcaaattccattttcatgctctgcaactttatcattaattattttacgatatgagaaaaagaataaactattcactttttcgattcttcttaggtcgatactattaatgacatttatatttgtgtttttttatatcatagattggggtatgaagggatattttagtgcgtctctacttgcatcttgcatttcttccattattacattcttattgattaaaaatagttttgcgtgttcttttcggagaaaattattggttaaaagtctacaatatgcattacctcaagtgcctgcaagagttggagttatagcgaatacttatgcaaatagatttatgatattaaattatatgacaacatatagtatcgggatcttttctatggctttaaagtttggctctattatgactctttttgaaagtactttttcgatggcttggaatcaatatctttttagaattgtgacagaggaaaaacaaaagataatggttgtacatatgttagaagttgttgttcccataatctttatgattgctttgagtattggactattttctcacgaaataatatattatttcgcagatcctaaatatattgaatcatcaaaatatatagcttgtatcagtttctcgattagcttattgagtgtttctacagttatgcagactggcccaaaagtattatctaaaacccaatatttgtcttattcattttttatatcgtgcgttactaatcttattcttttatttttattgactaaagaatatcaattgttgggtgttgtatgggcaatgattatagcaaattctatacttgttataagtagttggtacttttcgaataaaatctatcctattaggtttaagttaccattgcttttgatagaatacgtttttggaattatgatttgttcatatctctgttttgatgatagagaactggtatgtaggattatattagagatagttatgattgctttctatctttttttattatggagggcagtaaatagatatagaagaagttgttgattctttttgtataattataattttattagaatgaaattggctgtttttgcgaggaaggttaaaaattttcctctatggctacaaggaaggttatgctggtatttccaaacaatagcccgcttttctcctttgttttcttttttaggtttacgtccttttctatggaggttatgtggatgtaatttaggtaaaaacgtttctatcggttgggatgtctattttgatgttggtaatgccaaattaataacaatagaagatgatgtttggattgcaagtagagctcttctgttatgccatcgaagggatatgtctctgtattatagggatgaacggtataaaaatgtgccgcatttgcatctgcctatcgtgctgaagaaaggatgttgtgtgagtatgagtgctattataatgcctggtgttactattggtgagggggccgtagtaggagctggttctttagttactaaggatgtgccagcatggacgatcgctgcaggaacaccggcaaaagttataaaagagttaaagaaacgtggtagctgatttttttacaattatagtattatatctattctttattttatcttgtttttgtatatcatatcttatttttgatacaatagcacagaggaaaattgcattaaaaatattttttctttcttcttttttatattttcttttttctttttttgcgtactgggcttatacagtgaacaataattgcttttttcaatatccagatcaggataatttttatgaaatgagtcaatatttaggggaattacctaatgtaaagtctatttttgatgattgtttcactaatcaagtttatcgtcttttaacagaaaatcaaggagcgtatttttattcgggtttactttcttatgtagctaatcattatttgggaggcaataatgttctttttcaaattttgaatgtttcttttttagcagcattaatacctgttttcgtatttcgtatattactttctttcgtttctattagaagagcttttttaagttcagttgtctttattttttgctcttatgtcttttattattctccttggatattgagagatatacatatcgcattactatattctattggcttgtctatattgtatactccttttaaagtttatcgtttattactattatgcattttatcatttattacattttattttagggcagaacatggattattcatgctttttatgccattactttatgtgtacgaacaaactaaaaaaaataaaatagttcattatagtcttataggtataagtatcgtaataataatgggattaagtatcataattatcccagaaataatggctatccaaaagactctgaatagttatcaagaatttacgcaagatgcagcggaagagggtgggctggggaaatatatttatagattgcctatggggctgaaagagttggtagctgtgttgtactctcaaatgtctccttttccttcatggggaggaatcgttaatgctaaaaattttcctcaattaatcatcggtctagtacaaattatagctccagcattttggtttatagtatggttttgtgttattcagatccttcgttgtaaggattatcgtagtttgctacccaatatccttattctttccggatttatatttttggcttttttaatagctaattcaagtaatatcaatccgcgtagactgatttgtatgtatcctgtcttctatattttttatgttatagcaaaggagaattatcctttttatatggcaaagaacatgaaaagaggagtcggcatttactttatattatgtattgtatatttattcataaaactataaaatgaagttactttttttgatagactctcttggatcaggtggagctcagcggcaaatagttacaattattcctctactaaaacaaaaaggggtggaggtagaagtactttgctatcatgaggatacattttttatggatattcttgatagaaatagtgtcaaaatacattggttgttaataaagaatcctatattgaggatgtggaagatacgttcgtttattcgtcaaggaaattataatgcggtaatttcttttttagatacgccagacttcttgaattgtatatcagctattggaggacatacttggaaagtaataacgagtgaacgtagcgcaaaggaagatgctttcttttcatatagaggcagattgatgggatggttcaaacaatactcagatattatagtgtgtaattcaaacaatgctagtcggatgtggttgaaacattatccacaatatcggaataagttaaaagttacttataatattgttactttacctctaattgtctctaagtacatgcctcgtaaagaaggcaaaactcacattgttgtggcagcgagttatcagtatttgaagaatcccataaatcttataaaagcagttaatttattagatgatagccaaaaggataagcttatattagattggtatgggtctaaaaaagcttctcaaagtagtgcgcaagtttttaatgaatcaactaaattaatttctcaatataatcttgataaagtgatacatctaaatgaagccgtttctaatattgcagacagaatgaatgaggctgatgtagtagggttatttagtcagtttgagggattgcctaatgcgatatgtgaagcaatgagcttatccaaacctataataatgagtcgagtatctgattgggatgttttagttgatgaaaataatggtgtattgtgtgaatggaataatgttgattctatcaaaaaggcattaaatactattttaactatatcagatgatcaattactggcagcaggagagagctctgggaaaaaggcaaagttgttatttgatcctgagactattataaaaaggtgggaggcgataattgggttgtgagttaaggtggaaatgaaaaattatcaatgcttatttatgtgtctcattctgaaatttagaaaataggacatcgtattaacactacaaattttatcttttttctgtttgaagtaattattaagaaagctcgtaaagtatatgcctagattagaaaaaatgaaggttctgttaatagcgccttctccagatcttgccggagggatatcccggtggactaaacatattttgaattattataaggagcatacagaagattgcaatttggattatttatgttcggcgtattataaacattctattaaaaatagtttttggacaaaattatattcgggactttctgtattgttgagatttataagaaaagcatcaagattaaattatgatgtagttcatattaccacaagtgcatcaattgggcttattaaggatatttgtttagtaaagatagctaagcgatatagtgtaaaaagtgtaattcatttccattttgggcggatacctgaattatgtcattataaaaattgggagtggaagttattgaagatacttgtcgataactccgatgtggtaataacgattgatcagaagtcttatttatcgttgcttgcttctgggtttaaaaatgttgtgaatttacctaatccactatctaataaaatacttgagagtattgataggaagtcatttatttctattcagcctcgtacaattacatttgtagggcagatgttagaaactaaaggtatatacgaattagtagaagtctgttctcaaatatctggtattcaattgaatatgtatggaagtcttcctaaaggggtcaaagaaaaacttatagttttatctggaaaaaataataaatggcttaatgttgttggggaaatagattattctttaatcgttgataagatgatggcatcagcaatttttgttcttccaacttacactgaaggatttcctaatgtaatattggaaagtatggcttgtggatgcgctattattgcaagttgtgttggagcaataccagagatgctggctattgatacggaaaggccatgtggtatttgtgttgagcctaaaaataaagtccaattaaaacaagcaatagagtatatgttatccaaccctatggaagcaaagactttgggaaatagagcacgtgaacgtgtcattaaagagtattcgatagattctgtttggaatcgcatgataaatatatggataggtagtaaaataaattaaatagttagcgtccgaaaatgacatatgggataaacgatataaaatggaaaactgttaacgtccaaaaatgacatataggataaccgatataaaagtcagaactttgcttccgttaaatgaaaagcaaagtttatgtatagttacaatgattttgagcgtctatttttacgctataaattggaaggcgttccttccggtgtttcgattgagcaattctgtttgtcgaaccaagtcccttataacctgtttcccaaatggtacaaggatacccgaaagaagatagttcctattcaagttttgggtgctccctccccggaggcagaaatgcaggaaatttcttccccgcttccggaaggaactccggaagtggacacctagctttcttcgagtaccggacttcgaatcctggtggacatccccatgatcaacggtgttcatatcagtcagaaaaatttaagctacgaaggcttgaaaagtctggtagggaaactggaggtcttatgttgaatataaccggtctcaaccgttttttctttgtccgcgatttccacgatatgcgctgtaaatatgataaggttttgtccatcatccatcagcagttgaatcgtgaaccggaagacggggatgtttttatcgtgatgtccaaagatttacgtctggtccgcttattcagttatgatcaactgtcttatagcatgtttgagaaacgtttcagacccagatacaagtttatgcatgtaaccgctttctttcgcaaggaagcttaaggaacgggagtgtactcctgcaccttttgaagacccatattcagatatgacacccggagagaaatctaaaatgatcatggagcttgtggctgtccgtgagcgggatgccgaacgcatccggcgtgacgaggcccgcatagacgcgctgttgtccaaggttgacgaactgttgtccttgcagaaggctaccatggctacggaaaaggaactggacgattataaagcgatgaacagtaatctgttgtctaaaataacagctttggaggagcggctaaaagtccgaacaagaacctttatgaatgcaagagccagaagggaatccgtaaaaagcgtgtaaaggacggagaggaccatacccgtgacaaggatgacttcgacggtactccgcaatccatcggatctccgtctgcggaggctggcggggaagcggtggaggaggagggtgctgaagcaaaaccaaaggagtcgcgtctttatcgccagggactttcttaccgtaccatgagtgccgacaatacggtttgtcacaacagtgatatcggccggctgcccgcaggtgtcgtcatcatcaaactccctttcagcggccatcctgaaatcattgacgttgtttcgggtacgcacgcctccggttctttcctggcttatctggctttcaacaaatacgttctggatactcctctttatcgtgagatgtacagattatccggtgaatcgatgcgtgtgagccgcatgagtctgaccaattggctggagaaagactccattcatttccgtgggctggttacttatcttaagaatacttgtctggagaaggactccattgtcaactgtgatgagacttggtgccgggtaaagcgtgaaggatgctataagaagaaatacatatggtgtctggtcaacagactctccaaagtggtaatctattgctacgaggatggtttcaggggacaggatgctctggagcatatcctgggtgacagtcaggtgaaagcccttcagtcggacggctacaatgtatatatgtatctggatgatcatatggtagatatagaacatctttgttgcatggtccatgcccgtgcgaagttccagtatgctttggaacagggtggtgataaggatgccgcattcatattggagctgataggtgagctttacaaactggagcgtgagtatgaagaaggtaagttgtctcctgaacagataaggctttgccggaatgatttaaagaccaaagaaataatcatcaagttacgcggcaggcttgacgccttgctcagtgacgatcatccgccccgcggggatctgatggagaaggccataagttatatgaatactttttggactcagttgttcgcttacttgaatgacggttcttattcaatcgacaattccatagccgaacgatttattcgccccttagccggtgagcggaagaactcgtcatttttcggaagtgacaggatggcccgtgtctcggcggtgtatcataccatcatctcaacatacaagatgcagggtgtggctgtgctggattatttcaagagattttttagcgagattgttaaaggacgtagggattatgagcatttattgcccttgactatcggattgaactaacaataaatcttaaaaatcagtatcctttttgacgttatttattgggagaccgccttgtggcggctttccttgggctacacgtcaaaattggatgctaacaaatgtaactaatgaacgataaacatttaagctgtgttcttttggtcaatcaatcaacgggatatttaatgattgatatagtgaatgcttatgccgagaaatattctgatgttgttttgcttacgggaaatctcgatacgttgaaaagaacattggacaagtctgttaaagtacataagatagttacttatgttcgtacttcattttttatccgtatactgacgtggcttgtggctactttacagatttttttcttattgctttggaaatatcggcattatagggtcgtttacgtaactaatccaccaatgtcttatttcccatcattaattttgaagcaccaatattctgttatcgtttatgatgtatatccggatgcattgagtaatattggagtttaccaagattcttggatatataaagtgtgggctaaaattaataggcgaatatataacaatgctgataagatatatacgctgagtagtggaatggcagctttactattaaaatattgtgataaagataaaatagttgtgattccgaattggatgggtatggattctttatcgaggattgaaaaaacagaaaatccattcatcttaaaacataatttactcgacaaatttgttgtcatgtattctggaaatataggatttactcataatgtagaatctattattgaaatagcggaagagattaaagaaaatgaagatattattttccttattattggagaagggttgaaaaagaaagagttaatgtcatgggtgaaagataagaatttgaaaaattgttattttttaccatggcaaccttcgcaagatttgaaatattcgttgagtgctgctgatatatcaattattactctaactgatgaaacagctttggtaagtgttcccagtaaaacatacaatttgctcgctgtcggtacccctttattatgtatagcatctgatgaatccgaattggcgcatttggtcgcagcatatgattgtgggagatgttttacaaaagaaaaagtggctgcaatggctggttttataaaagaattgaaggcagacaatatgctttggagaacttattccaataattcactgaaggcatccttaaattatacctataaaaatgcggaacaatatgtatcgtagtttcataaagcgtttgatggatgtgcttatagtctttcttggcttgcttgtccttttacctgttttattaggaagtgctttttggcttcactttgctaataagggggcgggagctttcttttttcaggaacgtccggggaagaatggaaaactatttaaggttattaaattgaaaacaatgacagatgaacgagatgagcatgggagtttattacctgatgaaaagagattaacaaaggttggtaaattcgttcgttctacttcaatggatgagttgccacaattgattaatgtgcttaaaggggatatgtctttaattggaccacgtcctttgttacctcagtatttaccactttatagcaaagagcaagctcggcgtcatgaagttcgtcccggtgttacagggtgggcccaagtgaatggacggaatgctatttcatggagtaagaagtttgaattggatatatggtatgtagatcattgttcctttttgcttgatttgaaaattattttattaacaataaagaaggtattcgtacgtgagggtatcaattcggatgattctgcgactatggagccttttacaggaactaattaagaatatgaaagatatagcgatttatggagctggcggctttggacgcgaggtggcttgtttattgaatgctatcaatgcgaatgatgctatatggaatctaataggattctttgatgatgtaaaagaggttggatatactaatgaatatggaaaagtgctgggtggaattgatggactgaatagctatccttctgcgttgtgtgtcgtttttgcaataggaagtcctcatggagttgcaaatttaatggataggatttctaatcaaaacattgattttcccaatattatagctccgaatgtgcgttttgcagatgatgataaccttaaattaggtgttggtaatatcttctcttgggattgtcatattagttgtaatgtgaggattgggaactttaatatctttaatggatatatcacggtagggcatgatgctattataggtgacttcaattcttttatgccaggagtccgaatttctggagaaacgaacattggtaataaaaattattttggtgtgtcttctgttttattgcagaagaagagagtgggatataatactgtaataggggctggtagtgttataatacgtccaacgaagaataattccacgtatatgggaaatcctgctacaattgtaaaatattaaatattaataattatggaattaaatgagtttatagaaaaatttgcagaacaatttgatgaaacagaggaggcagtgttcactccaaatgtcattttcaaagagcttgatgaatggagttcattaatagctttatcggttattgctatggtcgatgaagagtatgatgtgcaattaaaaggtgatgacatcataacagctcaaagtataggtgatttatttgaaattgtatcttcaaaggcgaattgaaagatgtataatcctttttccttagttggtaaaaccatcttgataactggggcttcttctggaataggaaaggccactgctatagaatgtgctagattaggtgctaaacttatattagttggtagagatgagcagcgcttaaatgaagtctttaatttattggaaggagctggacatgaacaaataaaattggatttaacagagggttccgcactggaacagtttgttaaatcacttccggaaattgatggctgcgtgaataatgccggtataggtgggaaacttcctattgcttttatcaagaggagtgatttgcaatctattttggatataaatatgattgctcctgtgatgttaactcaacttcttgttaagaagaaaaaaatgaaaagaggatcttctatggtgctgacttcatcaatatcaggtgtcttttctgtggatataggtaatgctatgtattctatcacaaagagtgctattgatggttttatgaagaatgcagctattgaactggcagtcaaaggtattagagtaaattctgtaaatccaggaatggttgagactccaattaataatattgatagttttactgaagatcagaagaaaagagacatggctaactacccaatgcagcgttatggacaccctaatgatgtggcttgggggattatttatttgttatctgacgcttcttcttgggtaacaggtacgaggctaaagatagatggtgggtattcattgtaacaaattattatggcattattaactgtacaaaatgtaaagatagtaggtgtttcagctgctgtccccaaagaaatagaaaaggttggaatgcttgagtgttttgctcaaggagaagctgaaaaagtaatggctctaacgggtataaaggaacggcgtattgctcctcaagggatgacttgttctgattattgtgttattgctgctgaaaaacttatagaagaattagaatggtcaaaagatagcattgacgctttgatttttgtatctgtttcacgtgattatagtgagccgaatacttccactgtaatacaaggtaaaatagggcttcaagcatcttgctatacaattgacatccccatggcatgttctggttattgttatggtttatcagttatcgcctctttgttatcttcaggctgcatgaagagagcattgcttttagttggagatactccatctaaaattttatcttcattagataaaactctttggcctttacatggcgatgcagggactgcaactgcactcgaatataatttaatggcaaagccaatgtattttaatttattgagtgatggaagtcaatacaacgcaattatagccccttctagtggagtgagagaacctgtctcagaagaatctctgaaaatgcagattatagagcctggaattataagaaatagaactcatgtagcgatggatggtatggctgtgttttcttttactataacctgcgtccctaagtgcattaagtctttgtgcgaatatattaatcttgatatacaggagattgattatttgcttttacatcaggctaatgaatacattgatgagaaaataagaaagaagttgaagttagacaaagcaaaagttccatattgtttagaatattttggtaacactagtagtgggacaattccaatgaccatggttactaaaatacgtgaggaattgtggagtaaaagtcaaaaaatgattttatgcggttttggagctgggctttcatggggagcagtttatttagaaacagagaatgtgaaagtgttgccacttattgaatattaattaaatgtatatggaatctttttcaaacaaagttatttgtataacaggtagtaatagagggatcggaaaagaaatagcgtttgtttttgctcaagcaggagctgatttaattctttgtagtagaaaagaaacctctgaaaatactgattttattaatgaattatcaagagaatatggggttaaaatatatccttgctattttgatttggaagatgaagaatctatcaaaatagggcttgcttttataaaatcattaaaattgaaaatcgatgtattaattaataatgctggaatgtctcatttggctattctaccttttactcggattagtgatgtaaagagagtctttcaggtaaactatttttctcagttaatgataactcaagcattaatgtcgattatgacaaaaacaggaggaggatctatcatcaatatggcttcaatcgctggaatagatggggatattgggaatagtgtgtatggagcaacaaaagcttcaatgattctattcactaaggtacttgctaaggaagttgcgagcatgaaaattagggtaaatgctgttgctcctggtctaattgatactgattttgctgtaaaaatgggagagaaagcgatagcatcgatgaaagaaatatcttcgatgcatcgattaggcaccacttctgaaattgcaaatgcggttctttttttagcatcggagaaagcgtcatttgtgaatgggcaagtaattagagttgatggtggtattaagtaattaatgtaaatataagaaaaatggaagtgaaaagcaaagtatttgagattgtagcctcggtatgtgaaacagaagtgtcttttgttacagaagaaagtacaattggagattttccgcaatgggactctatgggacatttgacaattctttctaatgtagaggaagcttttgatattaattttgaacctgaagaaatgatggatttagaggatgtccatgatattattgaggctgtagagaataaattagcatagtttatggtaatagaagaaatcatgtatcaacattctttgaattctcctgataaaatagcaattatatcaggagaattaagggtgtcttatggtgagctttggcgtaaaatcagccaggcggctgactggtttagttctaagggttgggataaaaacagtaggatagtgatttctgctagtaaaaatatagattttatttatacttattttggcgctcatctagctggaatgatttgtgtaccaattgatccggaaaccaatgcgattcggttaaaaagaataatagaatgcgcgagtccttctgctattattggtgaactaagaaataaggatgtctatgatattataccattttcaaaagtgaaaggtacagtagaaagtacttttgattttcccaaaggaacagaccgggctgatttgttattcacaacaggaacgacaggacttcctaaaggggttgttctgtctttttccaatcagttggccgctgtaaataacattaatgcttttatagggaatactgcggaagatatagaacttttagctttgcctatcagccattcttttgggttgggacgtttacggtgcaccttagctaaaggtgctacgctggttttattaggtagctttgccagtatgaaaaagttttttggcgaaatagagaggtgtaatgtaacaggattcggtatggttcctgccagttgggcctatatcgtgaaaatgagtggtgataagatcgctcattatgcatcccaattaaaatatgtggagattggtagtgcttttatgcctaaagttgagaaagaaaaattgatgacttggttacctaatactaaaatttgtatgcattatggtctgacagaggcttctagaagtgcatttatagactttcatgcggatggagggcacttggagtcaataggaaaatcatctcctaatactacagttgaaatctttgatgaagcaggaaatttagttcaatcggggcaggaaggggagctttgtgttaaaggagaacatgtatgctccggatattggggggtggatgagaatacttttagagatgatttctatggcgattactttaaaactggagactggggatatattgatcattcgggatatatatatctgaaaagccgcaaaaaagaaattatcaatgttggcggaaaaaaagtcagtccgattgaggtggaagaagcgctgaattctatggcaggtattgaagagtctgcatgtatcggtgtacatgatgacgttatgggagaagtcgtgaaagcttttgttgtcggtcacttgacaaaagctgatgatgagagtattaaaaagaaaatgttgtcattgttagaaaactataaagtacctgtttatatagagtatgtcgaccgtatccccaaaacaccatcgggaaaaatacaacgattattattgaaataattatgaatgagcaaagtaaagttgaagagctattaaatatagctccctatgaagagagtatagagtccgaaaaagcttttactgaggctttacaggaagaacttatctttcattatgaaaataatgaaagatataagagcttctgtgataggaaaggctttgatcctcacaatggaatactctctattggtgatattcctcctgttgctgtgagtgtgtttaaagagcttggttttaatttaaactctgtccccaaggaggatttgactctggcactgcagtcttctgctacatcgggtattccgagtacagtcgtaattgataagataacggcaaaaagacaggggaaagcgatggttaaagtgatcagtgaatttataggtaaggaaaggaaaccatttcttattatggatattgatcctcgttcagcttcgggtaagttgcttggggcaagattcgctgctgtcacaggctatctgaagtttgctggtaaggttggatattttcttaaagcagatgagaacaatctgtcatattttgatgtggaaggtattcaaacatttataaaagacttacattctgaccagcctgttgttgtttttggcttcacttatattttgtatcagaatgtactacaagcgattttaaaatctaatattaaactacatctacctaaaggctctaaaattattcatattggcggatggaaaaaattggaaaatgagaaaataagtaaggagctgtttaatgagcaactggcacagtgttttgatattcatcctgaagatgttattgatatttatggattcacagaacagatgggactaaactatccagattgtggatgcggttgtaagcacgcttcttcttatgtaaaagtcttggttcgagatactgctacacgagctattctcccggcagggaaagagggaatgcttgagtttgttactcctattcctcattcttatcccggtaatgttgtgttgactgatgatataggtgtgctggaggaagctccttgttgttgtgggcgtccaggacagagattccgtattatcggaagattgaagaaagcagaagttagaggatgtggtgatattctctcaaataaactgacatttcagcaaaagacagcgcacgccgagtttcaagcaaactctcatcttgatgtccaatattttaaaggaatgttacagagtgaaacaggagaagaacagttgcaagagatagtatctcacctaaaaggaaaattggattggttaagaaatcaaccgattgatgcattaattggtcttattggagaagtatcgaagagatggctatccgatgaacgcttttcttttttgaaagataaaggtttattatttttgtcgaattggtgtgaagtatctcatttacggcagatagctgaacaaggtttaaaagggaatataagatattgtgatacattcttgtattttcctaattctcaaaaacattttttgagagcaaattcacgtgggcttgcttgtcattggatggctggtaatgtgcagattctgggaatttttgcattggttcagtgtattataactaaaaatgtgaatctattgaaagttgctgcgaaagataatggagttttttcatctcttttgagtgcttttgagggggtgtcttacacaactgctgatggctataaacttgaaggttcagatttgatggaaactgtggcagtcgtttatttctcaagggatgcaaagaaactgggtgatttaatgtctaagtcagctcatatcagaattgcatggggaggaagagaagcggtcgaaactgtagctaactatccttcaatgattgatagtgaaactgttattttcggtcctaaactatcatatgctgtcattgctaaggaagagcttttttctgaacaagctgcgagaaaattagcaagacgagtctctgtggatgtttctgtttttgatcagtctggttgtgcttcgcctcataatctttatattgaaaaggggggagtgattacacccgaaaaattctgtgaaatccttgcggatgtttttccgaaaacagaagctcaaatacctaaaccaattatatcggcagaacaaatttctgctgttcactcatctaggggagtatatgactttaaaggtaaagtttggggaagcgatacaatgtcatggactatactttattcagaagacaatgaactttgcaagcctgtatactcaagggtgcttatggtacatcctgttgagcatataaatgatgcgttggtacatattcaagattatattcaaactataggcattgctgcccctcaagaaaaatccattgattttgcaaataaagctacaatggcaggtgtgtcgagatgtcctttaatcggtagaatgttgaattttgaaatgccatgggatggtgtttttcttattgacaaattggtgaaatggaataccttgaatggaccactttgttaggctgaattttccgggaatggtgcaaattattcaatttgttaattcagtatttggatctaatacatacttaataaagaatgattattccaaaagttgttatattattgattgtggagatacggaacctgttatcaaattcttgctaaagaatgaattagatctccgaggaatatttgtgactcatacacattatgatcatatttatgggttgaatagattgtgtgaggagtttccttatttaactatttatgtatctgcatatgggaaggaagggctatattctgataaattgaatttgtctagatatcattctgagcaatttgttctccaaacaaacaatgtaatggtgttgcaaagcggacaaagcttgaagctgtttgataacgagattttgaacgtatatgagactcctgggcatgattggagttcactttgctataaagtgggaaatgtattttttaccggtgattcatatttacctcaatattctttagttacaaattttcctaaaagcaataaagaacaagctttagattcgttggaatggataaaggtactttctataggatgtaatatttatcctggccacggagatatagtatatgtctaatttaataaagaacttattgggtattttttcttttttcttcatcccttactacgtaagaaaatcaaataaacatagataatttcgttatgaacaaacgaatctggctttcgcttgctcacatgggtggccgtgagcaagactttataaaagaggcctttgatacgaactgggttgttcctttgggacctaacgtggatgcttttgagcaatctttggctgaatatttgcatgaagaccgctatgtagtggctttgagtgccggaacggctgcacttcacttgggcttgattctcctggatgtaaaacccggtgatgaagtgatctgtcaaagctttacttttgccgcctctgccaatccgatttcttatctggaggccaaacctgtttgttttattgctgttgccggtaattacgatgaacaggttgtttatctggacccttccgccgtttccatgaagaagggagaccgtgtccgtgtcaccggtggcatctttgagggtgtcgagggtgagtttgtccgtatcaaaggtgaccgccgcgtggtggtttccatccagggggttatggcggttgctactgctttcattcatccttctttaatcgagctaataaagaattaaaaactcagtgaactctgtgccctctgtggtgcatattccaatacgtaaataaatcaccatgttgtctttgcaatcagaaatcgattctttgtgcgctgtttcgcacgaacttctccatttaggtctggatggcgaacccatctactccgaccgtttccgtcagttaaatacggatgtgtatcatcgttgtgagcatcttttcggttcacacggacgtactcttgaagaggaagcttctctttgtatcgctttgttgaccggctataatgctaccatttataatcacggtgataaggaagataaaatccagtcggttctcaatcgtagttgggatatcttggatacacttcccgtctcgctgttgaaatgccgtttgttggtagcctgttacgccgaggtctttgatgaagagttggcagcggaggcacacgcaataatagacggttggaaggatcgggaattgacgagggaagagtttgagatggtggagcatttaaagagtttggaggaaaatccatatccgaatacggatatagaataataatctattactaaattatatgtttatattttaggtgtaatagtgctatatatgatttattggttcgtttttagttactttttgtaaatgtataaattttgaagaaaataggtataataacattgccactagatgcaaattatggtggaatattacaagcatatgcattaatgagctttttgaaagaaaatgggtatgatgttacattgtataataagatttatgtacgtgaaatttcaccatttgtttggccattaatttatatgaagagattctttatgaaatacatttggagacagaagaatttatctgtctttgcggaaaaagatattaaaaagataaattctcttattcaatctcatacaaaattatttgtcgataaatatatctatcctattgtgaatattgagaattttagatcaataaaaaaggaatctgtggatatatgggttgtaggtagtgatcaaatatggcgtccggattatttttttcatgtggaggacgcatttttggagtttgctaaagattggaatgtgagaaggattgcgtatgctgcttcatttggtgttgataggtggatgttttctaaaaaacaaactcttaattgtcaacgtttattgaagttattttcgtttgttggtgttcgtgaagattctggggttatgttatgccggaaatattttgatgtaaattctacccatgtattagacccgacgatgttattagatgttaataaatatgttgcattaatgggagatattgcaaaaaatgatctatctgaaaaggggttgatggtctatattttggataagactattgacaaacaagatgctgtgataaaactccaaacagttcttggatatgatatattttataataataatcctaacacaaatgatataagtttatcagcgatagagcgaatagcttctcccgttgaagagtggttgaaaggtttttctgatgcaaaatatgtaattacagattcctttcacgcatgtgtcttttctattatgttcaataagccttttgtcgcttatgctaataaaggaagagggcttactcggtttcattctttattgaggatgttcgatttagaagatcgtttaattagttcggtaactgaattagatgaacaaaaaataaataaaaaaattaattgggaaaaagttaatcagattcttgatgttaatagaaaaaaatctaagggggatttgttacaaagcttatcaaaatgatatcttttttgttggaaagagttaaatttaggattaagtcaatcattcttaaattttcggtaatagaaaaggtaaaaacatcagaggcagatatttatttaacttttgatgatggacctgatcctctaatcacggaatttattttggatatactggataagtatgatgcaaaagctacatttttctgtattggagaaaaggtgcatgaatatcctttgttgtataggaaaataaaggaaagaggacatgcaattggtaatcatacttattctcatttaaagggtgttgatgtcaggagtcaagattatgtgaaggatgtgtctaagtgtaatgatatattgcatgcgaagttgtttaggccgcctttcggatctttgaaaattatggagctgtttctcttgaaaaaacattatgatataataaaatggtctgttgacatgcaagattatgtaaagttagaggatgtacaaacacatattgataagatcacgaaacagataagtggtggagacattgtgttgtttcatttttctgaagaacatagtttaaatacactacagctattaccattgtttttatcacgacttgaaaataaaggatttaaatacaagtcaatgaatgctagtgttttatgaataaggtttctgtagtagttcctgtttataatgttgaagagtatctagaagagtgcattgatagtatattgaatcagacttatcctaatatagaactgatactggttgatgatgggagtattgataagtctggatatatatgtgatcaatatgctttggcagatgacaggatacatgttatccataagaagaatagtggtgtaagtgagtccaggaatacagggatcagcgtagcgagcggagaatttatttgttttgtcgattcggatgattggatagatagcaatatgattgaatgcttcttgaatttattattatctaatcaagctgatatttgtatctcttctcattattttgaagatgttcaaagacagttgaagatagataaatatagtaagaagcaagctatcgatttacttcttgcattttcgtttccggcttctatgtgtttaggattatataggacatctttatttattggaaaatgtttttctaaagaagtacatcattgggaggattttttatttcaatatcaagtggtcgcagactctgaagtagtgctgaggacaaaccaatgtttttatcattataggcagaggcaaggaagtgctaatcactctggaattagtcagaaagttatgtcttgtatgaaaataccttggattttaaagaatgcttctccgtctattcaagaaacagatatagcaaatgtttattcatttatgatatttcaatgcttcatggcttatgtgagaactgatattccagataatacctatagacgcgaaataattttctatattaaaagtagactatcatatgtattgttttctacttctatatccttaaaatataaattatctttagttctgtttattatttatccttatggtacttattcgctcctccataaaaaatacggtatgtgaatgattaataatactttaatgaaattgtctttttcttcttttatagcttcaacaggaattttattctctaggataataaagagagattctgttatgttgttttctagttttccggattataccgataatgcttatgctctatttcaatatatttctggatcaaagcaatatgatcattatttgaaagtatgggtactttctgataagacaggttataaagcatgtaaaaaggatattttgtcgaaaaattcgaatacaaaagttgtatttagattttcattattagctttttggtatttttttagggctaagtttgttttttgtactcatggattatatagtttctgggatatcagtcaaagagataagttgataaatttgtggcatggcatgccattaaagcggataggttcaatggatcctgccaaacatggagttaataagactaaagctcattatttaattgctacatcagaaatttttagggaattgatgtctaaaagttttaataacctggatctgagtagagtgttacttgttggacaaccgcgcaatgatttactttttcaaaagacagacttcttttctaaaagaaatatccaaaggaccgactattgttctgttggcatttggttaccaactttccgtacttcgattattggagaaacaagaactgatggtatttcaacgaacgatactatttcttttttgaatatagcagacttgcaagatctgaatatttttttatcggaaattaaaattttgttgattgtaaagttgcatccaatggatatattgcaaacggttgatttcccattgtttactaatattatgatagtgaaacaaaatgatttttcttttcagctttatccattactgggggcaacagatttcttactaacggattattcttcggtttggattgattatgatattttagataggccaatgggatttgtaatgaatgacatagatgaatatcaaaagtcaagaggcttgacttttgataacattagtgaggtgcttcctggtcctattttatctgatttagagtccctcaagtcttttttaaaaactcctgaaacttataaaaaggaaactcaaaacaaatttaatttatataaagatgatcaagcttgctatcggttgatgcatgtaatagataaacttaataaaaacgatttgattttttagatatatgataactgtatatgtaataggggtatttgacttgtttcatcgtggacatgttgagctcttaaaaaaagcgaaaggtcttggagataggctgattgttgctattaatagtgatgaaatggttgctaattataaaagaaagcctgttattaacgagaatgatcgattggcagtagttaaagcttgctcctatgtagatgaagcttttattattccagatttggataataaactttatgtaattaagtataatgtagatattatagtgcatggtgatgattggacaggtgaagggtacttaaatcagatatgtatgactccagagtttttgcaaaagcatcagattgaattagtttatcttccgtatactaaaggtataagtacatctaaaataattaaatctattcaagagttgaataatgttttataagcatttagaaatacctgtttttgtggagattgataatagagtacttggtagagttgataaaatgctcacatccagtcatctgtttttctctcataaaactttagtgacttctcctgaattatatactctttacagtcactttatagatagtaataaatttgatagtttaattcttgtccaaggaggaaaggtagaagaatactctttattgaaaaaacaatgtgataatttagatacactttttattgcgtttggtggaggtagtattttagatattgtcaagtatgcggcaacagatatgaatatcccttacatagccatgccatcaacactttctaacgatgctatttattctccagttgcacgcttaacgtgtaatgggaagaaaaaaagttttggagttaaacctcctatcggaattgtagtggatttatcgattgtgaagaagtctcccaagcagttgattttggcaggtgtaggtgatcttttatcaaatttgagtgctgtaaaggactgggagttatctagactttccacaggagaaaagattgatgaattatcttttatgttggcaaaagaagctgctgtttctattttaagatattctgagaaagatttatatacagatgtatttttagctgatcttgcaagggggttaataacttccggattatccatgatacattctggcaatacacgtgggacgagtggttctgagcatttaatgagtcacgccattgatgaatatttttctgacaagtctactatacatggtattcaagtggcgtgggcgcatttgttgatagagaaactgctgagaactgaaagtgagtataatatgataaacagttatttctctcgaatcggtttaaatagcatgataaaacagtatatccaattttccgagattgattttatgaaaatgatacctttagctaaaatgataagaaataggtatactgttttgaacttagtgggaagataggggaaatttaaattgttttatgtatgctaatagctgtggataaatgttgatgaaatttaatgcctctaaatactctaattatataaccttattttattgtatttcttttttcttagttataaatggtggtttattttcttttttgactaaaggtactccatttacgatctggaggcaaattttgacatttataggtttttcccttttgatgtgctcttttggaaggtataaaaatcgttcgttgataaagatagaaaaagatttattgttactaacatttttatgtataccgtattgtatatacgcctttttttttcaaggatatggcttaattagagttggatttgctttatggatgtataccgcaggatttcatgtggttttgttttcatcgtatttattaaattcttcaaaatataatccacattctatatttaagtttttttcgttgcttggactgtttttatcaatagggcttattattgatagccaaacattgctttttaaatttttggtattaagcgctcatgaagatatatcttatttggcagaggaagatttagctatgaatcgttgtagcttcttagctgagtctgttagcacatttggggtttatttctctttctgcgtactctcatcattttatttactatatcattcctcaaaaacgaagagccaatttttttatttgttatgttcttttcttcctttaataggatcttggtttacgggatcccgacaaatatttgtgattgtattattaatgttttttgctggttttgtctattatgtgatttgtgcaaaagggaatcgggttattttattggtaattttttctataatacttattgcatcaggttcagtaattacttcattattatcttctaatgaatatcttttggaaaggtatcttggggatgacaaatctactagtaaagctgatgatactaggatacggcaatggaagaatggcattgattacatgcaggaaaataaattagtcctattgataggtcatggggttggtagtgttcctataaagggggttagagagggcgaatttattgggagtaattatgaaaatacctttctagctaaaatggttgacgtaggtttatttggcattgtgctggtgttgtttccggttataaaaatcttctcattattacgtaagtataaaaagaaaagcatttttgattatttgatattagtgctgctatttaattatctttttgtagcatttgtttctccaaatggtgcaactctatcaacacaatatataatgtttttagttctcagtatttatattcatagggaaaaatttgaattagaaaataaatatgcttcttgttaatcgttcattatattgcaattatataccacaagaattggtctctttatatggctctcaatgtgtgacaaatttttgtagtaatcttattgaaggtaactgttttagtaaagtgtattcagaagttcctctgaatgtgagaaaaaatatattggcggaattaccttcaattcagaaagtaaaatttattcaggttcgtgtatttggaagttttccaatactaaggcacttaaattatttggtggaaaatttgttaatagtcagactattacgcaatgataattctatttggttttataatcttgaaaggcataacttacttgcttttatgcttttgaaagtaatctatcgtaagaaaatttatgttttactagcagaccatactccatctaataggcttttttctataactaaagttgcggaaatatgtttgtctagatttgttgatggaattttggctttgtcggaacgtttaacaatacaaaacaaaaatatagtttatatgcctggaattgttccaatgaatgccatcaactctataaaagaaactaatggggaaattgtaaaaaatgcatttttcttttctggtgcattaaaaaaggtgacaggtataaagatggcattagatgttttttccgaattgccagagtgtgaactttacgtatctggtagaggggaggatgaatcgttggtgatgaaatatgcttctaaatatgcgaatatacattatttgggatatctaaattacacagattatctttcttatttgaaaagatttacagtatgtctaagttttagagatcctaatctggctgaaaataaaaataatttcccatcaaaaattatagaatacttggcgtgtaataagctagttgtttctacaataagctatcctgagttgaaagatattaattatgtttactctaattttgataaggaacaacttaaaatgtgcattcttcagttatctcagatgaatgatgcttggtttgagaaatattcaaaccatagagacgctttactgcactatttttctccgatggcatggagtaatgcttttaatagagttgaatctataaacaaaggattatgaaacaaattgatgttatatttgtaacgccattgccggccttttataaagtgaatctcttgaatagactgtgcgaaaaaaagcgtgtttttgtgatttttctttatgaaatgaatagtcggagaaataaagattttgtttctcaagggattaaatttgactatgttattttatcgaagttacaaggctctcgtttgatttatctatggcggttgttaaagcgtgattattcatatcgcagtttaattctatcggggtgggattctttttatctctggtttttagcttttctctctccaaagagtaaaaatgcagtggtggtagaatcaacttattatgagtcgtctattagaggtttgcgaggactgttaaaaagattttttttaaaacgaatatacttggcttacgcttcgggagaaccacatattgaattattgaaacttttgtctttttcgggaaaaataatcaaaacaaaaggagttggagtttttaattatgtgaatcaaccttcctttgtttataagacacaaattcggaactttttatatgttggtcgtttgtcggaagaaaaaaatcttaaacttctgattgatgtgttcaattctttaccagatttaaaattgaatattataggttttggtcctcaagaggaggtattgaaaaaaatggcgtcatttaatatctcttttttaggggctatctctaatgataagatatttcattattaccagagtaatgatgtttttgttttgccttctaaatcagagccatggggattggttattgaggaggctatgaataatgggttaccagtaattgtaagcaataaagtagggtgttctatggaccttgtggcagaagatgtaaatgggattagatttgatttggatgatagaaattctttaaaaaatgccgtgctgaaaatttgcaatcctatctattataatgtattagctaaaaatatttcatgttataattttgaggaaagatctcaaaagtacgtcgcttcatttttttatatggagtaaatatgggggctcgtatttcaaaacggatagagtggattgatgttgcaaaaggtatttgtattgttttaatggtagttgggcatactcggttaccatcgattatttcgaattggatttggtcattccatatgcctttcttcttttttatatctggaatgacttttaaagtaggaaactataaatctttgaacttttttttatatctataatccgcaaatccaaatttccgccgaatccggaacgaagcgttcaattttcaggcaaaagaacaaaacgaagcgttcaaaaaaaaggctgcacacaacacttataaagccggagcaaaaggttaatgaagacctctgttccggctttatagtttcataaaaatgactttataacggcattaaaataatgctttaataatttgtctaactgattgaaaaaacgtatctttgttagtagttaagctgccattttatcaatgggaatgccttgctttttaaacaacattatatcagtgtatcctgcagaataattcatgtgggcattgaattctctttttgtgcagccttcaaatggatttccgatggttttatttgccccaatccactcacacaattcaattatagatgatttgtttgatgtaaaataaacgaatgaatgaccttcgaggacttttaaaacatctaagtaatcggacatacgccaatacatgttgtacgttccgacatcagtggatagataagggggatcaattaaaaacaccactccaggtacgtccttatattgattatagacctctttgtagtcgcatgaaacgatttccagcccttctaaatagtccaatgattcagggtatccattcttacggatattgttataaagaacttccttgctcatttcctccacagacaacttatatttcatagagaacataagggatgacgatagagtaatgaagtccacgtaccccacactcgcttcctcttcttcaatacgctttaaaacgcattccctcagctttcctttgattgccttatgtttgggtaccgaatcccctaccagcgttctaatgtcggctaaaagcttatttgtatgtggaatatgagccagcctaaatcggtagttatcaaaatcgttatagacaacagtggaagttggtttcattcttttggtaatatgggaaagtaaccccgagccaccaaacagatccacaaaaacggtatcatcaggaaactggtccaatacctttataaattctttggcaaacattcttttttggcccacaaatggcagcggtgccgacagattcattttcgtcatacgttcaattcaaatttaatattttcaactccggataacagttccagagtctggtcaatgttattttcatatatatgcacattcccaaggttaagagttatggatttcaaaggaagttccacctgtcttgccatcagataaagatgataaatatcagccggaagcccaaggttggcatcagaactgcgctggtatgcggataataccagttccccctcatcaatctggaactgcacaaggctcaggcagggtgcctggttgctttccaccccggtctctccaaggaacagaacatagttcttgctgttgtgtttttcctgattaatcttggctataaggggtggaagcttttcaaagtaagtggggtagctattcacaagggtatggccacaatagtcccaccaggtaatacctgcctccttatatctttccacatcccgaataccctgcataaacagtttcaattcttctttcagtttctttctggctatcccatggcattcaaatatatcaagtaaatcagctggggtcagcatgagcctttcgttcaataggtatttgatacagcctttcttgttggtttgggtcttgcccgtttggagtatcttgtctaatgtctggtaatacttattcataagctattgatttttgtctgtgcaaagttagccccatcagataacacaaggtatctccggcatattaatcacactgcaccgagcgtgcagtgctttccaaaccgtttgataatatcatacaccttgcgttcgcttactgaatatttatttgccaaaaaagccaccgcataagtggtcttctcaccccgatttttcatgacctcatactctgtatataagtctatgaatcgaaggtcatcctgcttgccgcccaaacttataagcaattcaagcggttttctgttaaatttaagtgcttcaaacaatgtcatatccaatcatttttgtacttttgcaatgccaatcatttatttaatgcgtaaaaacgccacgagagtgcggcagagggcattgcccccggtcgcgcactctcgtggcgtttttacgcattaaataaatgattggcgtctatattaacaggccgggggctttttttatccctcccccgaagggattgtcaatcattcaatccggtacaaatccaaattgaacttatccttcttttcccagccttcagccagaactttctgaatgaatcctactgcttttgtatagaagtctttcagttcatctaactgggtaaaagtatggtattccggttgttcatccgaaccaaacttaaacgtcaccggtagggtttctccgcccgtctgaacggctaaatcgtatgcaaccttatagttgtactggttctccgtagaaagccatacatgggcaccattgtacacgaagccggacaggatagctgcatcagtctggctattataccaggacataaccaatgtgcggatttcctcatcagtgggcttatgcccgaactcctcttccatgtaggaggcagagccgttctctttctcctgtacatcccagcggatgcgccatttgtcttttaccgggttcgtgcattccatcagcgacacaccggcacttccttcaactcttctcatgtaaacacgtatttggttctacctttgccgaaggtctctgtcttgatggtcgtttcaaacggaaagccatccggcatttctttcacttgtgcgagaatattcttcatttcctcgctgttggtgaagaacttctttgcctcaccgttcacttcaatggccacaatacagcggtcttctccctgctcggtcttgatacctgtttcgaagtccttcactacaatcggtaagtttaccagttcccggatgcttaccaccacgccgggaaatcgcttcttgccgtcctccggcttgtaagcgacattcaagtctttaaaacttctcatttctttgcctgttaattttttaaacaacttattgcagtcggcgtgtttcgtcatgccgtagaaactggcaatcagttcccgccgtctttttctcgattttacatcgtgcatcttccgggcaaacttctgcttgatacgtttccgcaatctcacatagtcaggccggataacatagccaaggaaatcaatgccttcttctacaggaaacacccgttcattcggcttgatctccaagtctattttctccatttgcccgtgaataacatcacgaatcttccacaattccgctttcgttttgccgagtaccagtccgtcatcgcaatagcgatagtaataacgaaccccgtacttatccttcagatagtggtctaaaaatacagacagaagcaggttgcctgctccctgtgaactgcgcagtccgaaactgataccctccggcagcattgtcacgaaccgctccagcagcaccaacagcctttcgtccttgaatattctgcggaagcaccacatcacaaaatcctgccgcacattatcgtagaatctgcggatgtcaaacttgtaggcatacagcgtgccttccgggtctttttgcagatcggtacgtatgcagtgcatcagatcatgagtgccacggcgtttaatgctggctccggtagtccggatatagcgcttctgcaggtgacgatccaccacgttcattacggcatataccgcaatgcggtcatacatggataaaatctgcaagatgcgacttttgccatactctttgatttccgtctcatggtacccaccaagttgaaacgaaccgttttcaatggcagcagtaagtttggatataacttcctccctatgtgcaagtagctttttcccttggattgattccttacgatccgttccgcgcagtacggcatcgaaagcctccgacatattggagtattcgatgatttcctctatgatatatccttccctgcgcatacggttctgctgttggttagtaaaaacagaagataagggccttcctttccccgggtctgacttcttcgaactgataacagcctaccaaactccacccgacgcgtgatttttcagctttccaccctaatgggtgctgttgctgtggcttgcttccctcggcaccgcattggggacacgtccccgctgctgtacgccgatcaattagatttccagacgagagccgacattcgcattcgtgttcgaagcatcgttattcgcattcgcattcgacacaccgccattcgcattcgcattgttgtacccgcgatagaccacacggactgtagagaggcttatccagtacttatcggaatagtaagtagaagatgatccgttcagattacctaccggaaccatgtccatatacttgccatgcgccacacctgttatccattggtcgctggacgttttaccctgcacccaccgcaccgtgccgtccggcatccaaatgcgccatttcccttggttgccgctgtcgttcggcagatccacgccgtccatcatgtcatacttgttgccgtagatgtcctcatagcccaggcagcagatattgttcacctgaaccacgattgcctgcccgtattcatcccggctcttataccaggcatactggtgcaccagcccgtcaaccagcgaattcgtgattttgctgttgatggcatacgcttcatcgtagccgatggtatctgtcatcccatgctctgccgtcccgcctgttgttcggttgttggtatgctgtccggcaccgcactgttcctgcatgtccctacgcccgtaccgtgcatagctcagattcgcaatgcggctgtgcatcagcgcatctatctgttgcatgccccgctgctggctgtaatagtggaagtccgtccaggtcatgcttgccgtggtcgaagctccggttatgcaggcacgcagcttgctgcccactaccgaactgcccacaacagcacacagatgctcttcgttggccacccaatccggttccatgtcctctatcttgtcgctgtggctcagtaccacatggtcaaactcagccgtgttcagaatggagaaatgcagagcggtcgcacgctccggaacgtctgctatcagatacatgccggcctcaaacttcaagccgatggtcggcactacgatgctcttcaggatgttgcctgcagcatccacaaacacactgccgataagccccgtaccgggaacgctcggaaagcggacacgtctgtagccggatacatccaccttacataccgaataagccttgtcagtcgtataggattccatcaacgtaggctttccgctcatgatcttgcgttcacccagccagccgccctgtgtctccttgatggcatccagcgtcagtaccgtcgcctccggaatcgggggcatttcatcctccgggtagctgctgtagcaggcgtacttcttgttgttcaaataatcgttgatgcctttgctccagtaaaacggctcatacatcatccagtctccctcgctgccgtccagcttcgccaccgtacagtcgttcatatcctccgcatcggcatagaagttcgaactttcgtcatgcagggggaaataggtcatctccccgtccgggttgttcacttccacctgctgcccggccatctccaccttccggctcgtgggcatcttggtcaccttagccaatacgcggtggcgcttggacaggatggcttttatgtgtccactcatcacatattgattaccaaacttataccctgttttattgtctaaattcgaaacattggcatcgtccgccacactgtcgtcaaactcaatcatcgtatagggcggctgcttgatggtcagttccggataacgggcggcatacttctccagttcctcgtcaaccagatacttcgtcagggtcagcttaccgcgcaggcccgaatgccggtcatccaccgcacccgtctgcgtgtacgttccgtaatcgaaatacttcttcagcagggttccgtcgtcttcccggtctatctccagcacaaagcgctccagcttgccgctgccgttcagtctggcctggtgcaggcgttccagcatggcaaacccgtcgatgccggggcagttcgtatagcggtagccgcgtacgttgttgatgccatccagcaccaggccgctgtcctgcagcttggtcagatactccaggaacagttcctcaatcgtgtccggcaggcataactgcacaacgggcgcaccggtagccagcttcacgcgggtcagtcccgtacctcttacgtccagtttcttcagtctcccctgccagctcaggtccaaggtggccacgtttccgttgtccccgttccgggccagcaggttattccgcatgttcacttcttccaaaagcagcatcccgttggtcgaagccatgaacgagccgttccggtacccgctggctatctccacgctcatgtccagttttaccagtgaggtcagcagaccgaagttgaacccgatggcgaacgcatcctcatgccataccagctccttgattttggctgcaccgataatcttcagcgggtcgttctcaccgaaggcacgggtcagctgcagggcgtggagcacgtctgcatccaccacgccgctgtcggcctgcacgccgttactggtggagagctgcacacggtacgggatggtcagccggtactgcatcggtttcagtttataagccttgtccagcgatgccgtactctggtagaactgggcacccagcgtggatacatagccgtactccacctgcttcaggtcataccggcgttggatgaagtagttccggtgtgctttcaacgaacccttcagaccgtagatttgcggataggtctgtttcgcgccgtccgcgcccaccggcatctcgttcaggaacggatacacatacttgaatatgccggacttgttatacaggcgcgagcaccacttcttcatctgctcggtatcgaagtggtcaatggctttctgaatgctgaaggcactcatgaagctggtaccgccgttcacgcccttggtcatcacttcctccagcagattgcccatgttgcccagtatcaggttccacagccagctgttgtgtccctgcatcacgtaggcaccgtcgcgcttcgtctgccggttgtcgtcatacttcccggtcaggaacgacttgttgtccgaacccagctggcagtccccgtcgtaataggttatccaccacatcacgccgtcccatgtccgcaccagcatgttttttgccagctggtccacacccaggttgaactgtacatacaggtagtaggcggccaggttgggcaggttgaaatacttcccggcttccttcctgaaggtcgggctcacccatttcgcggtcgggaacttgtttccgtcatcctcatagtccaccccgtcaaacgtgtgcgactccctgttataggtcagattcttgccggcaggcgtttccttcacgcatctgtaaaggaagctcatcatgcggtccagggccttgtacatcttgtcatacttgtcaccggtgcccaagtgttccttgatgttcggttcttcctcggcatcgccaccgccgtcgttccagaacacgtctttcgggtggttgaactcgaaaccgccgtcaaagttgaaatccatgaagtccgtatggtcgggttccgtggacggcagccaccggaacaggcacaggtcattcgagttgttcagcgtctcgatgcagatgggcaggtattccttcggctggtcgccgttcgcctgcaggtagttcagggtgtcgccggttccccattgctcgccgccgatagtcttgtcctgaccgaatatcgggtagctgtcgctcttctcgttgttcatgttatactggccgtaataggtcagatcctcatccacgctcttggccacaaacaggtcacagggcaagccgtcaatggccgagcgtatatcttccttgcacgtatctgcatggtcggcggcatactgttgggcaggggtcaggattcccatttccttcatgccgtcatgaatgaacttcgcaccgcccgtgttggtcgtcatggaggagtcggaaaagtcacatttcgcacaggcaagtttcgcgcccaccgagttgccccgcaaccggaacaggttcttcttgccctccgttgctgtcgggttgctctgctgcccgttgccgtctatctcgccgtaggtcatccgtgccgtgtaaccgctggctgtcttctggaagtagaagcgcaggttcttgcgggcatagttcaccgaactggtaccctgaatacgcagatatatgtcacgggctatccagtccagcgcccggttctcgccgttgtagaatctcacttcccggcacagtttgttggccttcttgttgttcagctgggccagcgcatccatcacattcagcgtgtcgctctcgctcggaacctcactgcccacgctgcccgtgcctatcagtaccaggatcgagttccggcgcttcttcatcagccccatcagcttctccatgctcaccgtgtccccctcgttcagcacgcggttgtcctcatccagcgagcgcacgcccggttccccgtcggcatcttccaggtggttgcggtccacgatgtagttgttcagcacctcgtccgaggtcagcgccttgttgtagatgcgcacactcttcacgttcaggtcggcacctgccgatttgaactccagctggctctggatgtcaaaattcaccttgtcgagccacttggaagcagccgactcttcaccgttcacatagaaaccgatcagcgtgcgctgttcgttggtctgcacgttcggatagaacacgtaggtaatgcggatattcgtgcccggctggaacttggtacccaccgagtcctcatagcgcagcacctgtccggcatccatcgcctcggtcaccacaccggtcaggaacttggcctcttccggagtcacaatcagcccgtaccggttgccgttgtccagctgccccaggcaggtgatcagttccgcattcgtgtccgtcacgttcgccgtgctgtattctatctccagcgtcatgcccacatcacgaatagcaaagccttcgggtttgtccgcctcgttgaaggggcggtacccaccgtcagcggtcagggtcatgcctgcaccgccggccagcagcaggcggtccttgtgccagccgcttcctgccccgtattcgttcacgctccaaagcacgtcccggaactccatgcgcttgtcaccgctcacccagcttgccgggttgttttccgtgttgcttcgcccgaaggcatcaaacgtacacaccgcatccggtgccagcgtagcttcaatgtcggggtgcgatgtggtgttcaccctcacctcaagcacggcatcaccgcacgacacacggtagtccagcggttccacatttacgttggtccgcccatagtttccggtctcgccgcgctgcagcaggtcttccttcaccacactgccctggttcgttactttcacgcgggccgtgtacgcatcgcggtcatagccggcatacgaaaagctccatgccgtgaactgctctgcctccagcaccgggtgtttccattctcgctggaatcccgcagcccggtggctgaacatcatgcccgcataggctgtcacaccgccgcctgccttcagcagcgtaatgtaatgcacccggctcaccacaccggagttctcatgctgtgcgtaggcttccaccacgttcgtaccttcctgcatctgcgtcagggggatggtcacgttcttctgctgcaccccgctgccggcagaaagaccgagggtaaaggcctgcccgccgttcacacggtagtagatgttcttctcgccgctcgtacccttggccgtaaaggggatgttcacgtcgttccggtacccgccgtcggccagtccgttgccaaccgaataggtggtctccagcgtcatggccaccatggtcaccttggccgtggctgtcttcatcagcgtgccgccctgataggtagcctgcgcctctacctgcacggtataggcggtggcatccttcaggtagggcgatgcgtcaaaggtgtagctctgtccggctgtcacacccgcaaactccgcatcctggaactcactgatcacggtcgaaccgcgtttcacgattacgcgggctttcaggtcgctgtagccgtccaccgtaccgccaccggcagtacccacgcccacggagtatttcaccacaaagccgcttcccagtgccaggtactgctgggagggaagtcccgctccgctgctgtccgtcaggtcaatgttcaccaccaccttgtcatcgtcggtgtacttcgagaagcgcacctccttcgagctctcgccgccctggttatccttctgcttcacggtcatcacgtactgggtgccgtcctcgctgtcctgcacatccacgtccgtcaccgtacccaccatcgcatcaaacaccgttccggatgtagggggcttcgtctcgccgcccaccagttcctcggtaggggtacggtttgacagttccttcttcagaaacgcttcgacatcgtccccggcataggcatgataggtgccgtccggctgtttctggttccacggtgtttcaagattcatcggatgttcagtcgcattgatgattccgcttattttcctttttgccataatactgtccttttataataatcattcatttatcagttttactgctaccgttccatgcgtccgatccgttccacggctcgtcgcctttccagtatccaagtccgaaacagctgcttatcgcagaccataccagtcttgcaccggcatagagagccgacagggcacgttttcccacatacgcagccgttatttccttaccgcctttggttatcatcgttactcctcctcataaatcagatacagcgtattcgcatccttgtcctgcagtgcctcataggcttcctcgctcatcacctcatgccggtaggccagaagtttcagagcgcctcccgtgccggtatatatcgcatcgcccagcaggtaaagcttgtccggcaggatggctatccggtccgcattcatgaacatgccggcagggggtactcccgccacgtcccagtccccgtacagggtggagtccatgtggtaggcaaatttcccggcaccggccacatacaccacgctgccgcccggcttggtacacttgtcaggtaaaacgttcccggtttccatccatgaggaaaagcgtgcagtagccccaccgacggctgctgccgtagtctgttccaccttggctgcggcattttctgccttggctgccgcttcgttggccttggttgcggcttccgtggcggcctgggtcttttcctccagtccggctacggctccttccgctttcttggcggcggcctcggcacgggcggcggcatcgctcgcaggtttccctatcagttccagggggacgttcaccattttcccgtccttctcaccgggcagtgatttcacaccgctcagcgaggtgacggtttccagatcctccacaccggtagaggactggagtacacggtccagcacttcctgaaccatttcttcttgcgtcatttctgccataaatctattcatctatcaattttacgatctgtgaataacatcctggggttagcccgattacagactcttttataagtatagcatcctcagcactaatggataaatccccgtttgcctgtatgagacgcatgcacaattcatacgaatggattttacggctgctatccttattagaatcaccggatgatcgagcaccttccccattaaaaaggcattgggctataatatctgtcatcagctggacttttccaccgactatgaggtcattccctctataatccttaaacgtcttgttaaaattcaccttcataactattcatttttatgacacgttaatgataattccattctgtacttctactgttttacccttgaatcgcccagaccaaccattttgaggaagcattttatcagcttgtaccacaccaccactcaccagaatattcccggaatgcaccaacacatcgccatcgaaatatcctgctgaaaatgttaatgtgtcaggataagtaggcttctcacgacaacttccataaatacctgctccaccaaatggagcaatacccatgattgcattactaaaattgtttgccttagcatagatgcaggtatctccggtccaatagtcgtcatatcccaatcgaatttcagcatctccattactccaaagcatgcaattcctttcaactgtaaatgttcctacctttcctccgtcctcaacaaatatttttccatatacagatgcattccggcattccatgctcccgtcctccagtatcctgaagtttccgttggctgtcaccagtccctccagctgtatatggtcggctgtcagcttgattttgctcactgggttgccatgttcgtccgtatcttccacactgaccccgataagggccaccttgccgctggcatcctgggcatacagccccgcaccctccggcttgatcaccagcccggtttctttcaatgcagccccgtccttgtcaaaaaccgccgctgaaatctttaccagccggtcgctctgttcgaacagtgtacggtacttataggccagtgcgtccgccttgttggtagagaataccagcagcgaaatgtaaatcacgcccgtaaacgacagcttgaagtctcccgtaccgttccaaaggccgtccagcgtgaacatcttctcgccgccaacgggcaggtcctcttcatggccgaacaggttgaagttttcaaacccggtcttgtcagcacccacaaattcgattttcaaccgtccggccttgatgacccggtagctgaaggacagatacaccacgccgggcacccgttcgccctggctgttcgtctgccggtactccggtaccagccggaagtcctccagtttctgcatgatatagctgttccggatataggcataaggcaccttgccgtcggtccgtatctcggcatgcccgtccggcttcgtaccgtaaggaccgccgttcgcccagatccagcgtccgcccagggtgaacagcgtagccttgctgcccgtcttccatttgtccatgccgtcggcaaaactgctgttgtccagatagctctgttcttcgcgtatttctttgcgcaagctttccacggctgaatggattttcccctcggttatctcaaaccgcgtcaggatgtcctcgcccgtcatcaacacgaacgtacccttcagccacacgttgtcggcatacaggccgtttcctttcggctgtttgtctgccgggaaagcgctgctcctgatgccgtccagcttacccagccggcagcgaaggcagccgttgaagttcttggccttcacaccgtccagaatgtcgatacggggctgtccgtcctccgtggccgcaatggatataaggttctgccggagcgggttttccgtgttgcccatcagcacgcactcatcgcctgcctccggcttcaccccgccaaactcgcttaccgggaccagcacaccgccggctatcactgaagccacctccacccagtatgcttttagtttcttaccacccgtaaccgcacagcgcatcaggtcatgggccacaaagcccgattcctgctcaaacacgatgcggtagttgtcgccctgcttcaccacgtccttgatcttgccgttggcagcggacaccaccagctggccgcacacgctgcgcaccttctcgatcagcagttccagcgccaccaggctttgccgggcagtcactttgtccaccgtcaggttcgtcagtccggtcagctggtcaatccacagctgccagccctcaccggtcagcccgtccacaaactccgtgctgcgcagcagttcgcggatcacggcagtcaggtattcggcattgccctcaccgtccacgatgccgcagggcttgccgccggcagcctcgccaaagctcacacccttcaggaagcggatggactctttggccgtgtccggccggttcttgctcaggaactctttctggctgcgccgggcggaaaacaggttgttgtccgtgggcagcgtcttgtcccagcttcgtatgatgtccggaagggcagcgccttccgtctttgatttcgtatagcttttcagcgcaccgatgctgtccgtcaccttgtcgaacttgcccacctgcagcgcatcgcttatctcgatgtccatctgcccgggttcgttcaccttgcggctgattttagtgatacggctctgacggtagcctttttccgggaaatacttccggctctccagcttcacccgtctgcccacaaacaggtctatgccgtgctcctcgatgtataccgggtctgtcggggctttgtaggcggcaatgtccagccagtactccttgttgtactcgtccaccgcaaccgcaaactcctcttcggccagccggtaatactcatccggcatccggatattccacaggatataggtgtcgcctgcccggggcaccagcttgccgcccggcagctgggtgtcgtcatcgtagggccagatggtgatcagttcgaattcacgtgccgcgctgtcgtagttcacctcaaagtagtggtcatcgctttctcccagtccggcaaggtcgcccgtctggaacgacacacgtttggtttcttcggccagctcgtacaggttggggtcaaagtccagttccccgtcccggaaataatagacggtgaatttgtttccttcatcgtctgccacctcctcgctgcgaaccgagctcaccgtaccgacccgacgggggaagatgccgctgaaagcatcctgctcgtaatggtcatagatgccgtattcctccacgccctgctcgatgtacttcctgccgccgggaagcatcagacgcgggctgccgtatttctccgcatcgatgttgcgggtcgagcctaccgggaacaggcgcgtatagaatttggccgtgttgctcgtatctctttccagggaggtcagccccttgccatagccaagggtgatttcttccccgtgttcgcagcggcacacgttcacagtctgcccctcaacccaccattccaccttgccgcctgccttttccgcgatggctttcagcgcttcgtcgcagtacatcccctcgtagtctatcgtgatcagctccgtaccttccacatgctatgtttgcccatcagtgccagaacccggaaaggtacggtatcaatttctttccccacttgtaaaaagagtttgttttataactttaatcctttgtttatcctttttttttcttcaagaatagggaaaccgtaaaaaatgctattctctctttttatcatatttcttagtcttttttctataagttcccatttatattgcccattaatcatctgaataggttctttaaaattaatatcttcaaaataagtaagtccttttaatggtctaatgggattagcattagggaatttgttagcatacgatttaagcatatcgtttaaagaaagttttgtagataagcatgcgatgtctatgaaatcttttaatctagtaccatcatcggctatagctgataatttcatagccgtaatatcttttatgctatataatctaactccttctttagtttgaagtggaacttctaaatatggataatcatgtgtaatacaatctatttttacatcattaatagttcctttcagtgtgttcttttcaaggaaagaagctttaaaatcatatttgtttattaaatatttttctaagtcttttgcatcgaattgattaggggtaaataagtccaaatcaatactaattctatgaccaagatataaagctagtgctgttccacctgcaagattaaaattttccaatcgtttatcttgcattagcatttctaggagtttaaaagtttctcccttaacagtgtccttgtgtagcattttagttcttgtttattcagattaaaaactgtgcatacgaaatttatatctttatgtgatagggatgggatttcttttattatattttgaaaattctcaataccaccatataatttgattgcagcatagaaatcgtcaatccatcctctttctattactcgttttacgacaagtgtccgcatatcgttccaatcaaagttagacaagtcatattcccaaagtaaacttttggaaatttcctttcctatacctttttgttgccaatcgttgaatatcataattttctatgaattaaacaagctctaaaacatttaatagttttataccaagtttttgctctaattcagcaatgcttttaaaagagaaattcactttccctgataaaattttacttatgtattgcggagatacgtctaaacgctctgctaatccgtttcgatttaacttattagtttccatatattctactagggataaagcaatattgcgtgaccattctaaccacaccttattttcctttctccattttgcattttcttcaaaatgagaaggagaaacactttcgtgtttttttaagaaatcaataactgtactcatattttatcctccatatttaaatctataaaactatctttgtcgaaaactccgttatatttaagaaattccttacacttattcaacttctctaattctaaagaagtatgttctttatcttgcatccgttgggttagcttgattgctccccctgttaccacataaacatttggttcaagccggatagcatatattcttaaccaactggcgtgtttgtttctgttccaattccgagcctttctacgtgttaattccgtacatctggtatctgtaatatcaagaggcatgaacaagccatctaaactttcagtatatggaaattctaaaatcatttcttctagttcatcagcatcttcaaatgtatcttgtatggcttctgaaactttttcaacatggaaattattttttaaatcttctatattgtctatgaagaagtctaataaataatctgcattattccatttctcgaataatgaagttaattcatcatgctctttatcatgctctttaacagcccataaatgttcgtagcctttgataactcttacaaatttcataaatattataattattctagttgcaaatatacggaaaaaaaagaagtaaacctataagtttagttatttaacaatcaaagacttgttttaaaataagtcttttagtgatttgtcgctttctattattctcaaaacaaatgtattagaagctgtaaattctatattatatccatcgaattgaaaaggataacctacagttattagatatgctgataatctggctatttttttattgattttgtaaattctcataattttgtttgctgttctttatactggcagccaaaccagctttaaaggtttgtttatctctttattttcaatactcaaagatagtgattttctataaatgtcgcaaataataagacaattatttttgttaaaaatagtttctgatttacagattgccgaaattttcttttccctaaagtttttggtatcataataatgttttctcttcgtccatgtccggcagaactcggaagtgtgcggtatcaaattctttcccggtttcctgcctgtgttcgcagaaaaggtatcaattagatgttatctttttgctgatggacgggcaattcctgaatagtgtcggtatcattccttttattgtgcagccgtctttctgtattcaggagtggagagaaacgacacaacaaactttagggaaaagaaaattttcgtgtagctctttccggttttcggggaagtgtatcaatcacatattatatatccatttattcatatattatatattcatatattatttatatatataatatgatattttattcctgctctttttccctaatgttttatggtatcaattttttgcggccgacttccggcagcttttagtatttggtatcaaaaaggcgttctgcagaatgtgccaggaataataattcggtatcatttcatcatgctatgtttgcccatcagtgccagaacccggaaaggtacggtatcaatttctatatttcgattataaaacaaagaccgaaaattttattttccggtctttgttaagagaaatctttctttttaatattcatcatttgtgatgaatatttctactctcctgtttttagcacgtccggattcacttgtattgtctgcaatgggttcactatatccttttccctcttctgttatattgtttgtttctataccaatagttctaaggtaattacctactgctgctgctctattttgggaaagtataatattatattctttttctccgacattgtccgtatgcccaattattttaatcttagtatttggtatttcagtaatgatattacataggtctgaaagcattttttgggcttcttcgttcaattcatacgaatcaaatttgaacaagatttcactttgagctgttgctttaaattgttcctttccatttttgtccttgtaacaggagattgttaagccatcaatagcttttagcttatttctcctagcttctaacttttcttgaatagctttatctctttcttctttaactaattttgcagctccaccaactattgaagcggttgaataattactattattttctatcatgtctttttctttgtcgcttagttcagcgttactgaaagttatcatatgcgttgaagtacacgcagtaagaaatgagataacgaaggctgctaatattattattttctttttcatgattatcttattgctataattggtctgattttaaatgaattttttttgcttgtactggttgctcttccttttgttaatgaagaaattagtgcaaacactttaggagtatcttttcctgctccatcttctgtagaactccagtaccaaccatcaaagtgcgttcctccaatgattgagaaagaagaatataccttttcaagattattagagattgctttgttttgtgcgatagagccaataaaccaacctgtaacaccttttggcgcatattctatagctttttgagctgctggataagctaagctatcctttatagcaaagttcattattgcggcagtattagctgctccatcaaagctgttttcatcttccgaaacattagctatatcctcgtctgtgtctattaaaggattttcttctaaatcttctaatgaaacggcataagcggtttcttttatatttggattattcccatcattacaccaaaatacaactccaatggcttctttttcactgggtgaaaaaagcgagggatgcactatacttccatcactacataagatactacccggctgtaatgatgtgtctataatatcttcgtgttttgtacatgatgatattacccctataatggataatagaattatatatatttttttcatacttatttatttattggaaatttgacacctactaataatccatttcggaaatggtcacgtgtccaaaatacaaaatcatttttttgcattacaaagacttgcattccatttctaaatgaatagctatattctaaacctatatcaatggaagcctgaaacccttttctgttagctcctaaatctgctccaaacctccatcttaaattactgtttttgcctcgtgagattgtaggtttatatgctgcacctatgccgaatgttttatagctccagaaactatcagagcataccttattacataccgggcatttatcatatgctgtagctaaatcaatatatagttcataagcattgtgatatttaccttcaaactccagccctacaactgcattgacggtatttttccattgccaacctcctgaaatattaaaaaacttatcaccatcaccagccattgactttagggaaataaatgaaatcataataagaaatataattttcttcattgtgttattatttaatattgttagtttcatttttttctgtggattcatacatgattttcgaaaaatcaagacgccctttgtttattagaaattttataggaatgccatcatcataactatcatataaggattcttcatcattctctttttttatattcgattccaagaacaaaaaaccatttttctgtaattgttccacttgccatattacattatcgaaatagtgaagtaggataaattgggatgtattaggggaatattttccttctgtgaacaaatagaagaattctttagtatatagccttcctaaatatgtggttaattcatttttgattccagtgaattccgaaccaacatttaaggtatgacactcattcaatcctcttataaatatttcagtttccctatcacgctttagcatttctgacaaaatacttatatcaggattacatacggttgctatgatgtaagcaagattacaatattctttaggatagtgtttgcagtaatagtatatggttgctgcaaaaatattttccgctgtcattttgaagtataaatattcatcccatttataagtttctctatactgcattccactcttctcaatagcaagaaatatatctttggatatttctatagctttgggaatactatttattttctctttatcaatggggttgtcaaaatagaaatcctcgttccagttaatggaacgtaatttataaccaagacttggggttataattggagttacttcttttttctcattgagaatattcatatgttttatttttaattattaaaaccagaatttatatatagcaattaaaattaaaaaaccgagaaggagtatctgtgttaacaaaatacctcgctttaaaatgtaatattcttctcgcttcttggattcttcttttaatgtttttattagttcttctatagacatctcaagttggctgcctttttccatagcattttctatgcgctttgtataggcttcgacacgtttcaattcttgatataccagttctaccgcaagctgcgggtttactttcggcgtggtgtctttccttttccgtgggctgtactgtccctgcttaacgggggaagcggttgcctctgggcgtgagtttgtttccatattaattcctgtttttatttattcggtaaaagcatctgcatgaagaatgtctgcataatcaattcttaatgttatagtacgtcctgaaatctgtttttcagatatttctatggtaaggactttttcgtctggaaaagtaaatttttcaaatacaaaaatattccgataatttttcttgaaaacaagattcttattaacttgcatcaatggaagtatttctatagattgaaaattagtagcctttgtttgttttttatcttcgattttaaagcgtatttggtctatatcatatcgtatttttgttttattaatcatagaaatatcaataaagaaatacttgtctaatgcgtagatattgtttagcacaattttcattaggttacttttgctggaaacatcatagaatttatttttgctgataaacattctatgtgcgtaatcatacatttgtgctttggttaagttcacttctggattcatatagctacgtaaatcagcataagggatattaaagcgagtgtatgcttttgctaaatcgctactatatactagcatatattgtacgaaaaatctttctgtaacaatggtgataactccactagctccttcttttgtgggttttattctaagagagttaccagtaggaatatcgccaacaatatcattgactgatatatcaacatattttatatcttccatagctataaaatgcgttgaaacatctttgttgacgtatataacctttagttcttctgggttttcacctgcaagctcgatgttttctccaataggggtgttctgtgcatttcctgtaataacagaaaccattgtgcataatgcaataaaaatctttctcatattattgttctttatctttgttgtttactaaaaaaacttgtgtattatattttaatttggctttgttttttttgatgtttttggaaagagcttgggttgtactacggtaagcatcttgtaaagcacctaaagcgaattgttctactccttctgattggctgttcatttgtatagtttggcttcctatttgcgctccaacatctttactcaaatctctaaaagctgatgaaggaacaaagaaaccttcttgtccgtcattatcatatacggataaatctactttcatttgtttgccatcaaccattatagaggaaatattaatgtgtactctttgggctttaaagccagatacattcccatataggtaagtgcctttagttaaaagagcgtcattaatcattatatcatctagaagccgtatgcgtactcggctaccatctgttacttttagagttttatctaatatagctgtgattagtgaagttttttgttctttccctacagtattaaaatatacttctgcgggatttttcgcttttacaacttctatagccttttcttttggcttttcatcctgttttttttgaggtgttctaggacgtggattttgcaatgaatctatataagccatttgcattttaaaaagctccatttcttcttgcatcttggatttttcaggagcttttctagtttctatttgacttgattcatctatagtaggaaatccttttatttgttgctccaattccttttctcggattttagaagcctgatttaaactgtcaatttgccttatttcatcattggagtaaagagaaccataactttctatttcactaacttcttcttctttatctatggtttgtatggatgaataatcagaagattttttgaaagctcctttaagtgattcaaatttactttttatctctctcttttctaaattagcatcaggaatatcaagatttaattcttccgtttctactaatgtagtttcctctgctggggcagagtttaccatatccttaattaaccatcctattcctagaataaaaggtaggatgagtataggaatgatgtacttgggctttttaatatcaatctgtttcatacgctatttatttaatttattatataaatcttttattcgcaaagtgtcttctggagttaatttcccattctttcttagttcattaatttcattttgcattttaattacttctaacaaatcgccaactcctatttgttttttttgtaggcggctgtcaatgctaatttgtcttttgttcttttcttcgttgaaaacttgcattgcttttctcgatggacgcattactattgatagaaatgtaactaaagaaagaaatgaaatcgtaattccaaacattactttgcggtgtatgtctgcccatgctaataagcgttcacaagcgttattaactccgaatctttgaaatattttagtaagaagaataactgtagcttgttcggctttagtcttgatcttttcttttctatcattctttttatgtttaaacagtttcattagaaattcttttttactttataatctaggtctttattgagtatcgttttccaatctgtgataataagcccatgaggattattttcagtacgtggaatttgtcttaatttccctgtagttacaagttgcctttttagaatggatgtttctcgttctatacgttggatgccatagtatttaaaagataggttgttcatatctatcttaatactatctgtcatgattgttacagttgcagaacttgctaaaatagtgttgaaatatcctttttcttttaagttgttatattgttttaatccactatcatcaattagatacatggctttttccatgttgtattttataaattcatcgtctggtggtaatgtgaaaaataaagtgtggaatagatttatgtggcttttacattctacttccaagttgacttctgtacctgtttgtttcactaatacaggtacatcattatccaagacatatattttctttctttccgcttttactaaagagaaacaaaaagctagtaccataccggaaataactatactagttgcaaaacagccaatagataaaattccggctagtttaattttattttctaagtttttaataatcatgattacgtgtgtttaaaagtttatgaatttttttacatcgctgcacttgctccacctgtagccggagctgctatggctttggttgcaattgctgctcctccaaccatacctcctaccgcttgccctactccagttgtacttacaatccatgtagaaacaaaaggtattgtaagcatggaaaatgctccaagtaatgctgtgagaaggaagctattgacacctccggaagtcattccgacatacataacaaatgcagcttcatttctaagcgcatattctaaaatttcaatttctctttctatcccatattgcattactactaaggaaattgatagtactatatatgcaatacatgaatataaactaacactgacaaaacgagcaatccattgtatataagcatcccgaaatgctggtaaaacagagaatgcaaaagctagtggaccaaggataactagtattcctgtgaatataatttgtaggaaaaagacaaaataggtacatacttgccaaaacgtaacaacaataaattcaatgatattaaacattatcattttggccttagcgactacatacacatataatccagctatcttatctccaatagctgaaaagtctatgctaaaatcataccattttttatcctgaacttcattttcggctctttcaacaagaattgaggtatgtaataattctacagcaacgctatcaataagtgcatacctattacgagagagtaactctacttcatctagctgatttgtaaacattgccttactttgtgctgtaagtacttctccgggataacttatcaagttaataaaaggaatccagaacataagaactaatcctagtgcgaatgggcgcaataatggaataatctctaattttttgtccccactcatcattttgaaactttccactccaaaatatagtaacataaagattgctgctaatgcctgtgcatctgctatgaactctccaaataggacagttgtcttatctcttagtctatcaaataattcaaataagtattgatctattaattcattcatggttcattattgttttatttatattattcaatcttgttattagtgaaagaacctctattagctctttatcaaaatctaaataggcttctctctttttggagttactcatatgtgaatcatggattatctctatgttcttttttattctagtaacttcatcggttataactttgatatgttctttattaccgttagtagaagaatattcaacgagctttttgtttatatcattgagaatatcatttcttcgattctttgttaaagtgtactgataatcaatcgttttatcgccaaatttgaaaagttcctgtttataaatggtatcaactttagagccttctttttcggttacggatttattatattttacgactgccatcattggaacttcttgtagctgaaagttacgcctatcctgtttcccgtatttgtcgtgtaatcctaaaccgactaaaggaattttaatgcctaagacttttttataccatatccagtaatgatagtattccggttgtagccgtaccctatccataaattccatattattaagcacactccattttcccttatcctttactggcatttgggaaaagacattagaagtaccaataatcaacattagggaaaaaaataaaagcactcttttcatattatcttttaggttttactttaaattcttatcaatttgatggattaatttgaaagacaaacgcttatggaagttctgaaaagtctaaggtaacgatttggagattgtgctaatttcagtactttacagtctcatacttatgaacaacttttataggacaaagatactattttttttgaataagagaataatttcacaggaaaaatagaaattttatggggaagtgttctgatagcatgtcgttgtagattgtagggaggggatgtaaaacggcaggcacatagaatttccgatattcagaaagccgtattcccaaaatagagattatttttgaaagaatcacataatccgctaagaataaaagtttatgcggatcatcaaaaaacgaggtaacgagttggcaaccgttctggtttctacatacttgcatcaattgcgttgatgtgcaactcactttatgtaaaggtacgattttttacggaacatgcaaaacacctttgatttttcttttttagcaaccgtcaaaaacaatctttcggtttcatatcccggtcacaaaggcggtacagtctctttatgaaaagtaaacaaaggtcaggcaggattgaaacagactgttacgagaacagtcagaaaaggattgcatacaggaattacagtctgataccgggcaggggacgactttgtgccaaagtccaaaaagaggttctttttccagacggcaaactccctcacctctaaaaaacagtctgtggctggcgcacgcaaacgtccagcctttatgcggacagtcttaatgcccgcagcctgtacaagtgcgtaaaaaacaggtaaatggaatcttcatccgcttccccgcgccttgccgacactcctatattcccgttccaacacctgctcgatctcgctcctcttgtacaagaccttgccaccaagtacatagtaaggcagcgtgccgttgctccgatactcgcccaatgtcctgcggctgactttcagcatacacgccacctcactgtcgcacaggtacacgtcttcttttggcggaaccgcgccatctccgaaaatgccgtcaatcatcgccgacagccggtcgatacgctcgtggatggactgcatccacgcatcgtctttcgttttcaattcattaaacattatatagattaatttgttatatgactcattttgtgactgattctgaagttgtgtaatccacaagcaataagaatcaccatatcttcgaaaccgaatttatggcatctgaatcgttctttgacaatacggcattttttcataccacctatggcatgctccactttaatcctaactccggaaatccgcttgttctcttgtttttcaacacaagtaagctctttccctttaggtttctttttgggcatgcatatttcaactccatccggtttgtgtccgatgaaacctgtatcctgccagagcctaatacctttgggaagtagaagaggttcttcatcacaaatctttttgtcatggacatgacctttgtatgtggagctcaaccatacaatccgaagattgttagtacataacaggttattctttatgctatgagttttttttaccactatagcatgcagactgccagtcttcatccaaaggacgctgaataggtcgctcggttccgtccaacaagacttcttcgcacccttgaagaatgtgtatcagacgtttggagttacggtcaggcaattcaccaagcgttttcaatgtacgccggagaatctcagaaagaaggtgaatccatctattggcctggggctgggtcatctcaaactgaatagcatggagttcctgaaggggattggtcttcagatataccaatatgaagaacattttgtcctgaatcagagacaacactgttgtaagatatacgttggcgcactttaccttccaaggtaaaatggctgtaatattcatcccaatggtacttgaaagttattagcaaagcgtcaaactcagcaggagttaatcctgtcgcagcaagcacttggctatgacggtggcgaatcttgtcgtaatacatcaattgaactttttagatcacaaagataaatcaaagaacgctttaatcaattattcgatataaactctattatacatactgctcatttgtcttttgttgatacttcagttcaattccttcaaatggtgtgccccctgtagcgtgcatccttgcgtctgtcctccactttcgtgacgatacgctccacgtcttccggcaggtaataggtacggttgcctatcttggtataggcgagcgtgccgttatcccgcaaggtctgcaaggtgcgcttgctgattttcagcttcaggcagacatcctggtggtcgagccagccagccgtcctcttcacgcctttcaaatccagatggggattccctccaccctatgtatgaaccgttcgattttcatggcaaattcctcgaacgccttcctttcaaaacatacggtttccataacaatccgattttatgttgatacttcaaattcataccatccggagaaacggtcactcgtggtgccggtataacagcgcatggaagaatttaatctgaaaactgaccgtgcagatgttattgttcccgccgctgagatatttctgataattgcaggtattgtcaaagctgagtatatccatgttccggtcattggcttagcagatggtattattgacaatttgtatgccatatacctgaaaacggaataaaaggaattgtgcatagctgttttaactaggggatattcagtaaatcctataaaattagccaactaattcatactaaaagtattgcgaattagttggctttttgtatctttaggtatttcccctaaaattttgaagaacgattgacaaatgcttcagcggagtcgttcaatgctaaaatcaaagctcttcgaagccagtttagaggggtggctgatctgaaattcttcatgttcagactggctaggctatacgcttaaaggaaagcttgccaaccggaaaaatccgctgcccctggaaaaagcagcatagccaaaagaaaatatagcagaactgtaaaatataaaagagtttgtgccaacgttttgacacaaacttagcagattactattcagctgatacctattctgaaagatgtaaacaacttgtttcttagatagccttataaatattctactacttattacagttcatttagaaatgttattctcacttttattcctccgctttttcacttgctccactgcttcagatatgattcccttgttttcaaaacgctgcgtgtaattggtgtaatccgggtgaatacgttcgtaagttgggtcagtgaataagggactcgtaataatgtggtccgcagtcgaacggttacagcagaaaacaatattttcaactccagccagtctggtcaatgctttcacatccgtatcatgcggctgtagtgtcatcggatctgtaaaaaagaacagatagtctatttctccttctacgatccgcgaaccaatttgctggtcacctcctaaaggaccagatttcaggattgtgatatcccatttgatttcaggatgtttttcttcaagggcttttttaattagtgtaccggttgtacccgtacaatagaatttatgtcctatcagacgttccgagttccagagaacccactctatcatgtcttttttcattgcatcgtgtgcaacaagtccaattctacgaacaattgtttccataaagctaaattattttatttttatatgataattataataacaaaaaaactaattctattgaaggccggaggatgaccggataaatctgagcaattctttgtttgcctggctatccatgacggtttcccgtttttcttcaaaaagattgagtgttgtggagcattccccacagatgtcaatgcctactacctgttctttctgaagaataacagccagcagtttctccaattcccataagctgagagaaccttgatcccagtttgttgctgccgaagccggattcaagacatccttgtctatggaaatgtaaaccggtccgttgatatgtccggaagaaaagttctgccaaccctcttcgtgcatgagcgtagtttcactgtaaaaccgaacttgtctttcatatcctttcggcacagcctgtatcagtttgtctgaagaacctacgataattactttcttgcagttgttgttatggtccaatatatcctttacccaacttccgcaagaaagtatgttgtcaaacaacggtggctgcatatcgggatggtggtcgaacacaatcagcgaaaacggagtttcaagtttgtctgtccagaatttagtcaaataatgataattgcctgaatcaatgaaatggactccctccgccggataatcagcaatcatccccttcaaagccaaagccccctccctgtcacagtagccatctgtaccataaagatgacgacaatccagccatataaatttattgttccgggcaaacgcctcgtagtcatacactcccgtgaagttcatgatgatgatcggccatgctatccgtttatctgttttttgattttgcccgctcatacgttgtttttgcatatccttttactgttcattaaaaccatcgtacataacagaaatcttgtcggtgaggtaacaaagcattcttgggatacatacggaaggcctgcttgaagcttccagcgttgaaaatgccggatgtcgccttaaaggtatataaattcccattcttggaaaccggcaaaaggggaataacctcatatatgtgatcctgaccgtcttcacgcctgataatgaccgattctattccgattgcgtcatccaggcctttctcatcaacgacaaccgtcacctcatattcctttccggcttcaaccgtggcattcagcccattccctgcctctatggatttgatttctatggcatcccatctgcttcggacgtttgctttccagtcagccatcattttcgccttcgcaaagttgtcggctgccagaatgtggaaatgctctgacagtttgttatagaacctgtcatagtagtcgtccaactgtcttttcatggtaaaatggggagcgatttgtgcgattgagttcttgatatacttgacccagtcttccgaatagttcttccccccatgctcgtaatacagtggcaggatgtcatgctccaacaaataatagatggcttcggcatccagctggttttggtactgttcattctgataagtccttttatcagtcagtgcccatccagcatccttacggtatccttcataccaccaaccgtccagcacggagaaattaagcacaccgttcatcaatgccttctcgcccgacgtacccgaagcttctgccaaccgcgtaggggtgttcatccaaatatccacccccgagataagatggcgtgccaggtccatgtcgtaattctccaagaatatgattttacctaaaaattccggacgccgggatatttccacgatttgcttgatcagcccctgcccggcaccgtcattgggatgggctttgcctgcaaagatgaactgtaccggatatttcggattattcacaatcctggcaagtcggtctatatccgtgaacagaagatgagccctcttatatgtagcaaaacggcgtccgaagcctattagaagagcatcgggattgaatctctcaaaaatggaaacgctcaatgccggatcaatctgactcctgagccagtccttgctgcatttgcttttgatatagtccagcaattttgctttctgttttaaccgggtattccatatctcttcatccgggatgccatagacggcctcccagattttctgattggactggtcgcagaaaaaattctcatcaaaattgtccttgaaaagctttttccattctgccgcacaccaggtaggcagatgtaccccgttggttacataacccacatggttctcttccgggaagtatcccttccagatcggcgcaaacatttgctgggataccgatttatgcaacttgctgacaccgtttacctcctggcaggtcttgcaggcgaagacagacatgcagaaacgttcctccttgtctcccggattgtgacgcccgagatccatcaggttatcccaggttatacccaacttgccaggatatcccttcatatatttattgaaaagcccttcgtcaaaataatcatgaccagcgggtacgggagtatgtacggtataaagtgaggaagcacgtaccagctccatggcctgcccgaaattcaagccgccatttatgtaatcacaaagccgctggatattgatcagtgcggcatgcccctcattacagtgatatacatctttcgttatacctaaagctctcagcgttatcatcccgcctatgccaagcagtatttcctgttttagccgattctcccagtcgcctccatacagatggtgagtgatagggcggtcaaactcgctgttgagttcattgtccgtatccagcagataaaggggaatacgccccacactggctttccagacattggcatgtaccacaaaactgtcggcataggggacgtggattaccagttgtttcccatccggttgcattaccttttcaatcgggagctgcccgaaattctgcgctttataattgactgtctgctggccgtccatggaaagcgactggtcaaaataaccgtaacggtacaaaagtcctatggcacaaaggtccacattgctgtccgacgcctctttcaggtaatcccccgccaacattcccaaaccgccggaatatatcttaaggacttcatccaagccgtattccatgctgaaataagctattgacgggcgctggtgatccggttccacatctacgtattttttgaaggcggaatagacggcatccattttatagacaaagttctcatcatgtgccagcgctacaagcttctcataatttatccgctccagaaacaataccggattctgttccacctctttccaaagttccgaatccaaatcacaatacagtttctttgcgtcatcattccatgtccaccagagattatgtgcgatttctgcaagttttcgcagttctgcaggaagatgtgaacctactgtaatctccctccactgaggggtatttacattataacttgaatattccatgacattttaattaaataagtcctaatctttattcagtccttttattatttttcgtttaccgacaatccataccgtatcattctccttgaaaattgtatcagggtctggattcataatattcacggtactcctctctattccgataatgatgctatccgatatgtctgcctcccggatcgtctttccgatcaatggtgaacctccttcgacaggaaattgccctatttccatctcatcctgcgaggatgttccgttcccgttcctttctaccttcttttgctccatggatgtccggaagctttccaactgtcggtccgtacctacgaccgtaaccttgtcatatggatagagatgttcttccccttgtggtatatctaggcgtttttctccacgggtgattgaaatcacatttatctgaaacaaggtgcgcaagctgctttcttttaatgttctgcccacatatatggaatcaggggatactgtgaaatccgccaaatgtaattccttgaacgggatattgctgccaaaggtggagcctgtatcactttctgtagaaagtccattcccgtccgtcccctgaaagtttgccataaattgtctctctatagtcagcgaccgtttcttgatccgcttggaaaaataaatgacggcaatgataatggaagagactaccaacccggctcccaaggcaacattgaaaagatgggtaatgatactcatcatgataatcgtgcagatcagtattttgacaagtactattgataccaaaggccctctgttgaacttgttgtccgtccagagtttacggaactcggttgaattgttccttttcatgatgatggcccatagaaacggggatatgacaagaaagatgatgatgaagcccaacaagttcccttccattcccggcagacttttcctaatcaaaggatgcacataggaaaaatataaagtgatgaaaaaaacgcatacgaccagatagagtgtgacagacaccagcatagaccggatcagtttatgccaagtaccctggtgttttacagtcattgccccggacgtatagtgtacgagataatctttcagggattcaggcatgtggatgtctataaaccggtatgctggttccgaaagccgtatcatatagggggtaagaaaagtcgttatgacagatactgccactatgaccggatagagatacttgtccgtaacattcagactgacgcctaaagatgcgatgatgaatgcgaattcaccgacctgtgtcagtgaaaagccggactgtatggcaattttcaacggctggccggaaagcaagacaccaaagctcccgaacagtacctgaccggacagtaccagcaatgtcaggatgagaatagggacggcatattcccacatcatggcaggatcgatcatcattcctaccgacacgaaaaatatggaagcgaacaggtcttttaccggctgtacgatatgtacgattttttccgcttcaacggtctctgccagcagggaccccatgacaaaggctcccaatgcggcagaaaatcccgcttttgtcgcaatcatcaccattcccaggcaaagtcccagagaggttatcaataaaatctcgttgctggtgaaacggcgtatcttcttcagcagggtaggtatcagatagatacccaatgccgaccagaaaatcaggaaagcggccagcttcaatatactttccagcatctccttcccttcaaaatgtttgcctaccgccaacgtggaaagaacaaccatcatcactacagccaccagatcttcgataacaagaatccccaagacaatgccagtgaatttctgttggagaagtcccatgtcattgaaggccttgaatacgatggccgtggacgacatggacaacattccacccagaaaaatactgctcatgtgggagaaccccattgcattccccgctgtataacctatgaacatcatgccacatacaatagtgacagtggcaacgatagccgtaatgcccacatttatcaatttcttgaacgaaaagtccagtcccatcgcgaacagcagaaaaatgacaccgatgtccgcccatattttgatattggcaggatcggaaacagtcgggaccagagaaacggaaggacccgccataataccggctacaatgtagcccaatatgaccggttgcttcagccacttgaaaatgacggttacaataccggcaataatcagaattatggcaagatccgatattaaaggagcaacttctgacatattaacggttattttagatcgataattcgttaaggacccggatcaggcttttgtcaataggcttgtcctttttgattgcctggacaaaaggaacataaacaatctcgttgttccgtatgcctatcataacatttcgctggccttccattaaggcctggattgcggcttcacccagccggcttgccagtatacggtcattggcactcggagcaccaccccgttgcagatggcccaggatagaaaccctgacatcatacccgggatattccttctttacccggtcggcgtaatatatggcacctccattcttgttttcaggactttcggtcacaattacgatgctgctgtttttcgtctttctgaatccgcgcccgatgaatgtttccaactggtccacgtccgtcctgtcctccgggatgatggccgcttcagcaccggaagctattgcgctgttttgtgccaggaagcccgcatcacgccccatcacttcgacaaagaagatacggtcatgggaggttgccgtgtccctgattttatccacgcattccacaatggtgttcaatgccgtatcatatcctatggtaaaatcggtaccatataggtcattgtcaatggtgccgggcaatcctatgcacgtcacatcatactcctccgcaaagatacgggctcccgtcagggaaccgtctccaccgataattatcaaagcattgatgttctctttctgtatgaccttataagctttcttgcgtccttcgggagtggtgaaagtctcggagcgagctgttttcagtatggtgcctcccctctggataatgctacttacatcttccgtcgtgagttctttcacttcaccggcaatcagcccctcgtaacctctataaattcctttcactttaaatccgttaaaaatggcggcgcgggtcacggcacggatagccgcgttcattcctgaagcatcccctccggaagtcagaattccaatatacttgttatccataatttgttttttatattttaattaatcaggcaaaattagaaagcaactgttttagcctttttctgctataaaagatacggctttttatcgtactcagtgacactcctatctttgcggctatttcccgatatttgactccggtacaacataaaaacgacataatgtgctttaggcaatgttttaagggcttcccttatctcttttgcatcatgcccgttatccacgaaaatgaaagagtcgtcccttaacaggaaatgatattcaggttctgataatacatataaattccctcgtattttctttgtccggcaattattgataaatgcattgcgcatgatggtatacatccagcctttaaaattcgtaccggaatcaaacttatccttattatccaacgtcctcaacattgtttcctgcaacaagttttctgcttcatccttgtcagcagtcagtttatatgcaaaacaatgcagttcattctgaagggctaccagcgctttatcgaaatcaaatcctctcattatatttattttggaattcaaatatccgggtgaaggcattccctgataataagaaatgccttctgtagagtctcatcaagatatcttatttgacatcaatagttttggtggtttcctgaaccttcttatctacgactttgggaatatcgataaacaggaccccgtgttccactttggccgaaattttatctttttccacattatccggcagcaggatactctgctggaatcgggaataggagaattcacggcgcaagtattttccgtctttcttctcctcctttttctcgtcctttttttccatgcagattaccagattgttgctttcatccacacttaccttaaaatcattcttggtcattcccggagctgccagttctaccttgtagtccttttcattctcaatcacattgatggctggagccgtagcgtttgctcttgccatccattcattgtcaaagaaatcgttaaaaatactcggtaaccaattctggtttgtttttacaggtaccatttttacctcctctttaaaagttaataattaaaacttaaaaaaaagcatctgcttgatagacagatttttattttttagccatcccttgtttggccacagcttctgcccgtttccgtatctcttccgggtttccaaggtagtagtccttgacaagaaccagcctgtcgtcaaattcaaagacataaggaactgccgtaggcaggttcaggttggaaatatccgtatcggaaattcctttgagatgcttgatgattccgcgcaggctgttaccatgggcgactaccagcaggctgtccttatacatcaatgcgggaaagatgatgcatttccagtaaggcatgacacgcccaatagtatctttcagggattccgtacggggaagttcgctatctggtacaccggcatagcggatatccatgcccggattacggggatcatctttgcctaccggagcgggagccacgtcatagcttcttcgccagatgtgtacttgttcttcaccatattggaccgctgtttcactcttattcagtccctgaagcatgccgtaatgcttctcgttcagccgccaggtcttttcaaccggaatccagtctttatccagccggtccaagacacagttcaacgtttttacggcacgtttcaagtaagaagtgtaagctgcctcaaaagaaaatccagcctcccgtaatgcatcgcctgccttgcaggcttcttcaactcctttctcgcttaaatccacgtccgtccatccagtaaaacggttttctttgttccatagactttcgccatgacgtaataacactattcttttcatggatacttcttctttatgcaatggttattgaagaatccagatatacgtcctgaatggtgttcagaagttgaattccgtctttcatcggtttctggaaagccttacgaccgctgatcagccccataccacctgcacgcttatttactactgccgttacgacagcatcatgcaggtcggattccccatgggattcaccgcccgagttaatcaatccgacacgtcccatatagccattcgccacctgataacggcaaaggtctatcggatggtcagtggtcagttccgaatacatacactcgtttgtctttccgaatccgatagccttgaaaccgccgttattggatggaagcttctgcttcacgatatcggctttaatggtaaccccgatatggttggcttgtcctgtcaagtcggcagcggcatgatagtcggtaccatcctttttgaagctgctgtttctcaaatagcaccacagaatagtagccattcccagttcgtgggcatattcaaaagcctgtgacacttccactatctggcggcggctttgttccgaaccgaaataaatggtagcaccgacagctacggctcccatgttccatgcctctttcaccgtaccgaacattacctggtcgtagctgttcggataagtcagcaactcattatggttcagcttgacgataaaaggtatcttgtgtgcatatttgcgtgccacggcgcccaacacaccgaatgtggatgccacggcattacaccctccttcaatggccagctttatgatgttttcgggatcgaaataaagcggattgggggcgaaagacgctcctgcagaatgttctatgccctggtctacaggcagaatggatacatagcccgtattggccagacgtccatgtccgtataaagcctgcaaactttccaatgtacggatattcctgtcggaattcatccataccttatctatcatatccggtcccggaatatggataagttgtttgtctatcgtcttacatgtatggttcaggtagtactcagcctttcctcccaataaatctactattttcattttatttatttttattgattattctggtttatgactcccgttcacccagttttgcatccataaaaaggatagcacagtctccggctttcctcagatgactaacaatattgagtacattcgcttcatcttctacttgctcacgaacaaattgccacaagaagtcctgagtggcattgtctttctcttcggatgctacctgtaccaactcatcaatcagtttggaaacatgtttttcatgctccaaagcatgctcgaatacttcaacagggttaccccaaccttgtggaaccacatcgaccttgtctactttcggggttgcctcacgcttaatcatgtacccggcaatggcatatgcatgcccggtctcttctgcagactgtttctgcatccagcgagccattccggaaaagccctctctttccagataaaaagacattgataaatacaggttggcagaccataattctgctgtgatttgctcattcagagcattttgcaatttttcagtcatgatgaatcaaacttttaatgttaataataaatccaaattatctacctgttggcggaattaatttgagttgataatatgtttggaaagttgcgcatatcgggcttatcagcccaggtatgcgggctgggataaagagttgtatgacaatggttaatctactacacttctccggtaatagccggtcggattctttcttaaaaaagaaacaacgaagcgctgcttccgcatcgttgtgtgcgaatggagggttttgtgggggggcaagggaggaaggcggttgttaaatgaaagagtcgtggtccggcggagcatcttttgcttctgccgaactttcgtggtaagccttttcgagcatttcatccaatagcgaagtcaattgctggcagctctcttttatctgttccgaacattctgccttttgggtgggcgaaagtgaagtgcctactatcagttgagtctgtttgttgatgtgattgagaggaatgtgcacatcgttatacatcgaccggatgaagttcgattgcattcgttcgctttcctgagccttttgggtctggcgcagaaactctttttgtagtttgcgggtacgtttcaggttgattgaaagataaacagtaaagccgatgacaacgaaagtcagtaggatggtactgtaaaaagcaatgttcctgattcgggtaataatgtccgctttttccagttccagttgtgcgacttcattttttacctgtatttctccaagttcgccgagttgttctttacgggtcagtgaatcggccagaaacatagcccggtcgtaaacctgacaggattcttcggcacgtcccatttcccggagtaatttggctttggtcttatagtgcgtcaccgaggccgtattgatagccttaccggtttctaccatctggatcagtgaatcacaaaaggcgagtgcttgtggatattcgcccagactactgaaataactttgacttaaatcgtagaaaaaaagtttattgcgtaacagggcatctccttttccgtgacggacatagttacaataacgcagataatattcatgtgctttctgtcgccctatcaattgatggtttagcatcagttgctggtagcacagcacatataaactgtttttgtagaagtaagggcggcggcggattacatcttcccgactgaaatattcatccagtctttgcaagtactggttagatacttccatcaggcgtttgctgtctttcagactgcggtaactcacgcttagcatgatatatagattgcctgtaaagtttttgcgggcagtaggtggaaaaccctctgccaaattccatccttcttcccaataggggagggcatttttataatctatattttcggtcatagccattaacagataatggatcactccggtgaggaatagacgttcggccttttcataaggcgtttccgactctttccggtcgttcagttcctgctgtatccggttgcagacttttatcctttcttcccggggagcaagttgcaggagccgggctttataagtcattttgtaataggtggcaagtccctcttcatctgagttttccagcaacttttctgcttcgttcagcagaagggtaagtgaatctttcttttccggatcctgcatatagtgaatggtgagtgtgctgagagatgcgccgatggccattttatcgtccgctttcttcccttcggtgtaaagtttccgggcgatttccaattcatcgggtgaggaatcggacaggtctaatatattgattagtaattcggcacgttgagtaggctctttcgttttttgcagtatgttttgtaaactgtccttgatcgaaggggcggcttgggatattgttacaatgaatagcaatataatccagatgtagtatttctttttcatttcttagcgttctccatcggtagggtaaatataaagcgggatcctttcgtatacgtcttgtcaatgtagatatctccttgcatgtgcctgatgatcagtttacaaaggtaaagtcccaatccgcttccttgcctgaaagtatccagtttggtgaagcgccggaaaacatattcgtgcttgtccgtcggtactccacatcccgtatctgtaacactgaccatcagcatcttccgtctgctgtctttccggcaactgagattgatgaacccctgagtcgtaaacttattggcgttgttcagcaaagcccggagcaataagctgagatattgcgggtgggcatagactttataatcgttctccggtaaattgagttgataatctatttccggttttccttccgtttcttccagatattgcatttcgagacggcaatagtggtttatttctataggtttcagtgtgagacttgctgtcaggctatccagattggccacttctaccaggctatggagcagtgaggtgagcagacgggtgttttcctgaataataagctggtaatccttttgttcttcgggagtagagaaatcatcgcttaatatttcggagaagccgttgatagaattgagcggtgtacgtatttcgtgacagatggatttgataaaagatgctttcacctcttcgctctcctgtgctttgatgctctgttgcaatacctctttttgaagtctttgagtcttggccagtgtctggtagtaatataagctgatgcagatagctatgaacaagatgcatagagcaaagatgaaagctacctgacgcttttctgactgcaaatttattttttcaagtaataatgtatttacatcatgtttctggcggagggagtcgacctgtgcaccatactctttcttaattagtgagtcggaaacgatcattgatcggtcgtaggctgcgcaagcctctttatatcggtgaagacaacgcaacagatgccctctgttctggtaaatttcgacgatgttgatgttttccggagcttttcctgcttctatgctgcggattagtgagtcatgccgtgcgagtgctttttctttttgtgcttgagtgagtgacaggtaacaactgtcgggaaggaacttcccctttgcagatgtaccgtagtcactgtacttttctgccgggctgtcatttgacaaaacggcaaaatgcttcgtttcgcttgattctgtagcttgtacggtcgtcgggatacctgccaactctacaaataataacagcattatatagtagcatgcctgtttcatctctaattttaaaacttgttatatttatcttttgcttgtataaaatagtctgctaaagtacgcaaaaacttaatttaatgcaatgattttgaatggaaatgcgctttatttatatctcggtgcggtaatctgaaaataatcatgtaaatttgcgtcaatttaataatctgattattatgtcgtgtatcctacatattgaaacctctaccgccgtttgttcggtagctgtgagtgaagacgggcagaatatttttgtgaaagaggaccttaaggggccttcacatgccgtttcgttgggagtatttgtagatgaagcattgtctttcatcgatagtcatgctattccgttggatgcggttgccgtcagttgcggtcccggatcgtataccggattacgtatcggtgtttcaatggcaaagggcatttgttacgggcgtaatgtcccgttaatcggtattcctacactggaggtactgagtgtaccggtattgctttatcacgaattgcccgaagacgcactgatttgtccgatgatcgatgcccggagaatggaggtatatgcggctatatacgaccgtgcgctgaatgtgaggcgtgagatttcagccgacattgtagacgaaaattcttatcttgagtttttagagaagcacccggtttatttctttgggaacggagcagcaaagtgccgtgaaaagattacgcatcccaacgcgcattttattgacgacatccatccattggcaaagatgatgtttccacttgccgaaaaagcgattgctattaatgattataaagatgtggcttattttgagcccttctatctgaaagagtttgtggcttcccaacccaagaagttactttgatacttttcaaccctttggattttctattttcaaattaaaatttaactacatgcagtataatactcaacagaaaagaatgccgctgcccgaatatgggcgcagtatccagaatatggtcgattttgcattgactatacaagaccgttccgaacgccagcgttgtgccaataccgttatcaatatcatgggtaacatgtttcctcatttgagagatgtacccgatttcaaacataagctgtgggatcatctggccattatgtcagactttaagctggatatagactatccttacgagattatccgcaaggacaatctggtgacgaaacccgattcgattccttatccgagcactaagatccgttatcgccactatggccgtacactggaagtgttgattaaaaaggcatgtgagtttccggaaggggacgaaaagaagaatctggtagcccttatctgcaatcacatgaagaaagattatatggcttggaacaaagatacggtggacgaccggaagatcgctgaagatctggctgaattctcaggaggtaaattgcagatggatgacgagattttgcgtttgatgtctgaacgtattgcccagaattatcgtccgcgtacgaataacaacaataaccagagaaataataatcagagaagaaaattctaagtaaggagattattatcattaatcattaaccactaatcacctaaaacatggcttcatttgtaatcgaaggaggacacaggctcagtggggacattcatccgcaaggtgccaaaaacgaagtgttgcagattatctgcgctacgttgcttaccgccgaagaagtgacagtaaataacatcccggatattctggacgtcaataacctgattcaattgatgcgggatatgggagtaacggtggcgaagacaggtgtcgattcatatagctttaaagctgaaaatgtagatctcgcttatctggagagtgatgaattcctgaagaaatgttccagcctgcggggatcggtgatgttgatcggaccgatggttgcccgttttggcaaagcaatgatatccaaaccgggcggagataaaatcggtcgtcggcgattggatacgcactttgtggggatccagaacctgggagctgactttgcttataatgaagaacgtggggtatacgagatttcggcacaagagctgaaaggcacttatatgctgctcgatgaagcctctgttaccggaacagccaatatagtgatggctgccgtgcttgccaaagggatgactacgatttataatgccgcttgtgaaccttatttgcagcagctttgtaaaatgttgaaccggatgggagcaaaaatcagcggcatagcttcgaacctgctgacgattgaaggggtggacgaactccatggaacggatcatactgtattgccggatatgattgaagtaggcagtttcatcggtatggctgcaatgacccgtagcgaaataaccattaagaatgtctcttacgagaatttaggcattattcctgaaagtttccgtcggttgggcattaagctcgaacagagaggagatgatatttatgtaccggctcaggactgttatcaaatcgaatcttttatcgacggatctattatgaccattgccgatgctccctggccggggctgactccggacttgttgagtgtcatgctggtagtggctacccaggcgaaagggagtgtgctgattcatcagaagatgttcgaaagccgcctcttctttgtggataagttaattgacatgggggcccagatcattctttgcgatccgcaccgtgcagtcgttatcggtcataatcatggatttactttgcggggtggcaatatgacatctcccgatatacgtgccggtatcgccttgcttatcgctgcgatgagtgccgaaggcattagccggatccataatattgagcagatcgaccggggatatcaaaacattgaagggcgtctgaatgccatcggagccagaatcacacgcatatgataagaagagaagacgtatataagatcggattattcaataaaccgcatggtatccacggagaattgtcgtttacctttacggatgatatttttgaccgggtggactgcgattacctgatttgccggctggatgatatctttgttcccttttttatagaagagtaccgttttcggtccgactctaccgctttggtaaaacttgaaggggtggatacggccgaacgtgcccggatgtttaccaatgtggaagtctatttcccggtggagcacgtagaagaggccgaaccgggagaactgtcatggagcttttttgtgggttttcgggtggaagatgttcaccacggtgctttaggtgaggtgacagacgtagatacatctaccgttaacactttgtttgtggtggaccgggatggagatgaactgctgattccggcacaggaagaatttatagccggtattgaccagaaacacaaaatcattacagtcgatttgcccgagggcctgctgtctttggacgagtgcgatgatgaagaaagttaaatagcataaagaaacaggcggcaagtaaagcgaaatgcttacatttgtacgctatatcctataataatgccgaaaaagaaacgcagtaaagctttttggaacaatattaagttcaagtacaaactcactatcatcaacgagaatacgctcgaagaggtggtgggacttcatgtatccaaattgaacgggctttccgtgttactttcggttctgaccctgcttttcctgtttgctgctgccattatcactttcacccctttacgcaactatttgccgggatatatgaacagtgatattcgtgcgcaggttgttgagaatgccttgcgggtggattctttgcaacagctggtggaccgtcagaatatgtatatcatgaatatacaagatattttcagcggaacagtgcgggtggataccgtacagtcaatggattcactgaccactatgcgtgaagattcgttgatagcccgttccgaacgcgaagaagctttccgtcgccaatatgaagagaccgaaaaatataatctgacctctattacttctcagcccgatgtgaacggattgatattctatcgtccgacccgtggtatgatatccgatcattttaatgctgagaagaaacattttggaaccgatattgccgctaatcccaatgaaagtgttctggctacccttgacggtacagtcatattgagtacttatacggccgaaaccggttatctgatcgaggtacagcataaccaggattttgtatcagtctataaacattgcggttcgttgctgaagcgtgagggagatactgtgaaaggcggtgaagcaattgctctggtcgggaatagcggaacgctcactaccggtccgcatctccattttgaactttggcacagaggacggccggttaatcctgaaaaatacattgtattctaataatgaacgagataaagaaaaaacaaatagctatcttaggttctacgggctctatcggtacacaggccttacaggttatcgaggagcatcccgaactgtatgaagtttatgcactgactgcctataataaggtagatctcctgatagctcaggcacgtaagttcctgcctgaggctgtggttatagctaacgaagagaaatatgtacaactgaaagaggccctcagcgatctgcctgttaaagtttacgccggtactgccgctttatgccagattgtagagtccggtcctatcgacgtcgtactgacagctatggtaggctatgcagggctgaagccgaccatgaatgccattcgtgccggaaaagcgattgcgcttgccaacaaggagacgctggttgttgccggagagctgattaatcagttggcacagcaataccgtacaccgattcttcctgtcgattctgaacattcagccgtgtttcagtgtttggccggagaggtgggcaatccgatcgagaaagtgattctgactgcttccggtggtcctttccgtacatgtaccatggatcagctgaaaaccgtgacgaaggtgcaggcattgaagcatccgaattgggaaatgggagccaagatcaccattgattctgcttcgatgatgaacaaaggctttgaagtgattgaagctaaatggctgtttggagtacatcccagtcagatagaggtggtagtacatccgcagtctgttatccattcgatggtacaattcgaggatggagccgtaaaggcccagttgggtatgccggatatgcgtctgcctatccaatacgctttctcttatccggatcgtgtcaactcgtcttttgatcggcttgacttttcgaaatgtacgaaccttacttttgagcaacccgataccaagcggttccgtaatctggccttggcttacgaatcgatgtataggggagggaatatgccctgcattgtcaatgcggctaatgaagtggtagtggctgctttccttcgtgatgaaatcagctttctcggcatgagtgatgtgatagaacagaccatgggacaggtatctttcgtacagactcctacctatgatgactatgtggcaaccgatgcggaagcacgccggattgcccgtgaattaatttgtaaataaataaattgtaaataatctgatggaaacatttttaatccgtgccctgcaattgattatgagcttatctttgctcgtcatcattcatgaaggggggcactttctctttgcccgcctgtttaaagtacgggtagaaaaattttgcttattctttgacccttggttcacactattcaaatttaaacctaaaaaaagtgagacagaatatgctgtcggttggctgcctttgggaggttatgtcaagattgccggtatgattgacgagtcaatggatacggagcagatgaaacaacccgaacaaccatgggagttccgctccaaacctgcatggcagcgcctgttgattatggtaggcggcgtgttgttcaacttcctcctggccttgttcatctactcgatgattctgtttaaatggggagatcagtacgttcccgtgcagcaggcaccgttgggtatggagtttaatgaaacagctaaggctgtcggctttcaggatggagatgttctgttgtcagccgatggagtggactttgtacgttatgacccggatatgcttagccagattgccgatgctcgtgaggtgaccgtgttgcgtgagggtaaaaaggcttctgtgtatattcccgaagatatgatgcaacgcctgttggctgacagtgttcgttttgctgaattccgcattccttatgtagtagacagtgtgatggtcaattcacctgcggcaatggccggtatccaacagggagacagtatcattgccctcgatggaaagtcgatttcttattcggacttcctgatggctatggctgaccgaagaaagaatgcagcagcattacagaaagatagcctcgatccgcaccagatcacgttgacttatgtacgcgacggaaagacagatatgctgactgtggtcactgactccgctttcaagatgggggtagtggctattctgtatacagatcagcttcttcctgttataaagaaggagtatggctttttcgaatcattccctgccggtgcggcgttgggagtgaagacgttgaaaggttatgtgggtaatatgaaatatctcttctccaaggagggtgccaaacagttgggtggtttcggaaccatcggcagtattttccctgcaacctggaactggcaccagttctggtacatgaccgctttcctgtctatcatccttgcgtttatgaacatcttgcctatccctgcactggatggtggacacgtactgttcttgttctatgaaatcattgcccgccgcaagccgagtgataaatttatggaatatgcacagatgacgggtatgatcctgttgttcggtctcttgatttgggcaaatttcaatgatatactgaggttcttcttttagacggaagtaacatcttataaataaactacgagctgcaagtgattgcgtgattattccgcggatacttgcagctcgtggtttattatcgttaatggtagttttttatattttcagcatcttcttttctctctccagatccgattcatccaacttgggtgacggtactgtacaggtttttatgtagtcgccttcctggcatgtatagttataatagatctcttcttccggtgtcagttccgctttgggaatcagtctgccttccattttcagaaatgcgtctatatccgtgctgtccgattgcttcaccaggacgattctccgcgctatcgggttgtggttgtagtccaggcatagatacaatccctttagcatgttgggatattcataatgtggcagttgcagataaatggtgaccatggcaaactgtggcagttcccgttcgttgaacatcagataggagttttgatgattgctgatgatgccgcttccccaatgtaccgatttataagcattgatcatgcctaccttgacgtaatcattattctctgatgcgcagatcagatagggttctgccttgagactgtcagtcgatgaagagagactgtaactcagatatgtaccgctatagttatacacttcttctacagacccctgcatttctttttccaggagtttcaggaacgtatttcccatgttgtttgtttcctgatcgggttccaggtcgaacaagcgctccttcattccgctcagattgccaagcaggcgttttttcgacacattgttcaccaaagccagtgcttcgtccagtgcctcttcctgtgttttggttttttgcagattcaggtaagcaggaagtacactcgaatagagtgcggacaacacactgggggccatattgatccagtcggctatttccttcattttcactccgttgttacggaggtattctattcttttgtatatctcttcaagttcgttcatggtatatcgacacgttgtttgcattgcaaatatatgacttttggattatataatcatgatatgaatgttacattaatatttcagcagaaccctgcagaatatgaatgaaatgaatcctgcaaattcatttttgctctgtccgctatgccctacatttgcaccggattcaaaaacaaggaaaaatagatataaaatgaaaaagattgaatgtatcattatggactgggccggaactgcggtcgactacggatgtttcgctccggtggccgccttcatcaaggcctttgccgaaaaagggctgacgattgatgtcgtgcaaacccggaaaccgatggggttgcccaagattcagcacattcgtgaactgctgactatgcccgaagtgaacgagcaattcactgcccgctatcagcgtgactggacggaggaagacgtggtggaactgaaccggctgtttgagaaatatctttttgcttctctgaaagagtacacagatcctattccgggtgtaatccctaccttggaaaaactccgtgccgaaggactgaagataggctctactaccggttatacacgtgaaatgatggacgtggtgcaacctgcggctgaggctaaaggttatcgtgtagactattgtgctactccgaatctgctgcctgccggacgtccggctccgtacatggttttcgagaatctcacaaaactgggcgtgccgtgtctcgataccgtggttaaagtaggtgataccattgctgacatcaaagaaggtgtcaacgctaaagtatggagtgtgggaatcgtgttgggcagtaatgaaatggcacttactgagaaggaggccggcagtctgtccgaaactgaactcgaagcccgcgtctccgaagtcaaagaacgtatgctggctgcgggagcctcttacgtcattcgtagcatcgaagaacttcccgcactgattcaaactattaattcaaaactcaattcttaaaacgatatgaaaccttatttgttattaactcccggacctcttaccacatcagaaaccgtaaaagaaaccatgatgaccgactggtgtacatgggacgaggattataacctgcacattgtggaggaaatgcgtaaacaactggtaggcattgccacttgcaatacggaggagtacacttccgtacttttgcaaggtagcggcacttattgtgtggaagcagttatcggtgctgccatcggaaagaacgataaacttctgatttgcagtaatggtgcttatggtgaccgtatgggaaatattgccgaatattatcatatcgactatgatctccttgcttttgaagaaacggaacaggtatcggtagactatgtggacgattacctgagcaataactcagacattactcacgtggctttcgttcactgcgaaacgactaccggtatcctgaatccgttgaaagagttggcacatgtcgtgaaaatgcatggtaagaagcttattgtggatgctatgagcagcttcggaggtatcccgatggatgtcagtgaactgggaatcgatttcctgatcagcagtgccaataagtgcatccagggtgtgccgggttttggattcatcattgcccgtcgttccgagctgatgcgttgcaaaggagttgcccgctcactttcactcgatatttatgaccagtgggagacaatggagaaaggacatggcaaatggcgcttcacttcgcccacccacgtggtgcgtgcattcaagcaagctcttaccgaactgattgaagagggaggagtagaggcgcgctaccggcgttattgcgagaatcaccgggtattggtggagggtatgcgttcgctgggattcaagactttgctcgatgatgccatccagtcgcctatcatcacttccttcctttacccgaaagcaggattcgattttaaagatttctatactgctctgaaagctaagggatttgttatctatcccggaaaaatctcaaaagcggatactttccgtatcggtaacatcggagatgtacatccggaggactttgcccgcttggtagaagttgtgagagagactgaatactaatgaatgattattgagtttttgtctttaacgtagaaggttgtgaaagccgcatactactcaccactgctgcgacaaaagcaaatccgctgcctgctatcagacagaccgctgtacttttttcgtgtactacgaaactgaagagtaaagcaaccagcgttgtaccgaatgtctgtcctaaaagccgtgccatacccaacattccgctggctccccccgaacgttgtgtaggggcggaagagatgattgtactgttgttgggcgtctggaaaataccgaaacctgcaccgcaaagcatcaatcgcagaatgatactgatgaccgatgaatttgctgttaatgtagataaagaataaagcccgatgcagaataatgccataccgatactacccagtatgccgggatggatgcgctccacaaggtatccggctgccggtgctgtcaccaatgtggcgatgggccatggagtcagcagcaatcccgtcattacttcgctgtatcccagtgagttttgcaggaaaaaaggaagagaaaccatagccagcatctgtgctgtgaacgaacagatggaagtcaggatcgataacctgaagataggtattcccagcaggtcgagcggtaaaagaggggacggctggttcagttgcctgtggacataatacgtgccgacaatggccaatacagccagttggatggctatataatcgtttttctcgtgatgggcaaatccgtccagtgtatagataagcagtccgaaggtgatagcgttggctatggcactgagcttatcgaatttccggttggaacgttcttcttttctcgataggtacttgcatcccaatatcagggctgcaagtcccagagggacattgatggcaaacaaccaatgccacgaggcgatggaaagaatgccgcttgccaccgaaggtccggctgcagccgatatggccactaccatggcattgatccccattcctcttcctatctgatttcggggatagatggtacgtaactgggcagtgttgacactcgtgatggctgaggcgctgaagccctggaaaatgcgggcaagggtcagagtccagaacgaatgggagagggcgcatatcagggaagtgactatgaacatggcaatgcctgaaagaaagatcttccggtatccgtatatttcgcctaacgacgaaaacgaaagcagagatatcacaatggcgagctgatacccgttgatgatccaggttgtgaccgcaggtgaagttccgaagtcgtgcgagagggtcgggagtactacattgatgatattgatgtcgagcaccgacatacataaggcgaaagagatgccgacaactgcccagatgcggcgatggagggggagaccgtcagtttcgtcaatttccgaagtttgtgtaagctgagccataaagaaccttttaaaagaactgccacaaaggtaaacaaagtcaagcttcttcggtttgagaggacaatgatatataagtttttttaattcatgaatttcagcgaggcatgtagcggaagtctttttcaatacggatgacacagatttacactggatcttattgttgataatcagcaaaatgaatcagcaatccatgtaaatctgtgtcatctgtagttctgcttccgatacgccttcatgtgtatgtcagcctgataatcctctgattgctgctacctctgaattccagatgtggagagtaaagttcttgtctgaagcgtccgtccaccaatacatctatataaggtagtacggcagccagtgccggatctgcctgaatctcttcgtacgtatatcctgtatagcaccagatattctgtcctgtctcttcttttatcctccggataagcggaagaaacgcttccgggttgtaaaggggatctccaccggagaaagtcacgccatccagtaacggattcgaattgatttcacggatgatgcagtccagacgcttttctgtcaattcatctccggcctgcggattccaactttccggattatgacaacccggacagccgtgccggcaacctgccagatagatggaataccggataccttctccgtcgacaatcgtttccggatatgtataaagtatattcatgacttattacagatgcttcacgcgatctctctcttctgcccgtttggcagagttccacgaactcaggtcgcccgtcagataacctgtgatgcggcgcatgcgcaggatattctcactttggcatacgggacatttatcgtaaatcactcccttgtatccgcagttgtggcaggtgtctaccgggtggttgatagaaccgtagccgataccttcgtcaaacattacttttacgatcttggcaatggcgcgtacgtttttctgggcttctccgtccagttccacatatgtgatgtgtcctccgcgggtgatggcatggaatggagcttcccgtttgatcttttctacaatgctgatcggttcttttacatccacatggaaagaattgacataataatcgttgtctgtcaccccttcgatttttccgtatttacggcggtccatacgggtgaagcgtcccgacagtccttccgccggtgtagccagtaccgaatagttcagattgtatttggctttgtattcatcagccaccttgttgatttccagcacggcttcataaagggtgtcccatgctttctggtcgtgcccgtgcccttttccgtagagtgccaccatggcgttgtgccctcccaagaaaccgattcccagtgttccactacgcaatacgtcgcctacttgctcgttcggattcagggcagccccccctttccacacgtcgttacccatcataaaggggaactggcgggccagggccgtacgctgatattgatagcgtgaataaagctggtcggctactagggtagccatttcgtgtaccgattcgatgaaaatttctttagcctttctctcaacggcatctttgttatgcttgtcttctgtcatgttttccgctttgatacgggcttcaatggcaaggcgcggcatattcagcgtggtgaacgaaaggtttccgcgtcccaaagacgatttctcgccggctacgttctcaaacacacgtgtgcggcatcccatggtggccagttcgtaacggtaacgttgcgggtcgttggcgtcccatttttcgttttggttgaacggggcatccaggaacataaagttagggaagagtgcttttgccgtagtgtggcaagcttttaggaacaggtcgaagttgggtgcttcaaattttaatttaccttccatggcagcatcgaaattagccatagccttttcataatcggcttctgtgtacgatactccgttttttatcttgaatatctgaatggggaataccggcacttctccccttgtgcccagtccctctacggttgctttcagtaattcttcaatcaccatgcgtccttcggccgaagtgtctgttccataattgatcgaactgaacactacctggtttccaccgcgtgagtgcattgtgttcaggttatggataaagccttccatggcctggtgcgtatctttctgagtctgcacaaatgctttctctataatttggttcagatgttctttgtcgatattgatctgtagggcagtcagggccatgcgcagcgtttcgcgttccagttccgatgctttgatggacgacagatgttcggcaatcactgtacggatagccttttcttctatttcttcacccttgttcatctgtacatagaagctgatgaatgatgccaggtgtttacggaatgatttgcttaccccttttgccataaagaagtcgaatgccggtatggcctgacctccgtgctgttcgttctggttagtctggaaaataatggtagccagggtagcataactttgaatgctttgcggagtacgtatactgccgttcttggtgcggaatccacgttcgaagaggtcatccatgtcatactggatgcaagtcgtggttttggtcgggtagtaatccaggtcatggatgtggatgtctcccaattggtgcgcctcggcaaaacgtttcggcaacagatatttatatgtatagtctttggttacttccgaggcaaatgtcatcatctgtccggcgggggtatgactgctcatattggcgttgctcaggttgacatcgtttttatcgatagctacgataccgtccatcacatgcttcatctgggtctttttgtctcgttcggtgtttcgccattcccgatagatgatgtactttttggctacttccggacgaaccttcatcagctctttttctaccaggtcctgaatttcttctaccgtaatggtaggagatgcaaattgtccgattacgttcatcgtgatgtcagcaatcaattgctgttcatcattgattcctgtggcactaaacgcttttgatacagcgttcttgattttactgatggagaagtcctcccttttaccatctcgtttgatgatacaaatttccgcgtagttcataactttaactcccgaaagctttagattttttttaatatgtttactttttcagcaggtcttctgacttatctctccctcgcaacgccttcccacgctgggcgcagtggcatagtgtgcggattctcagagaattacagcagcgggtactgtcgccgatttgcacagcgttccctcgtgactaaacctctttttagtgctgaaatctgctacaaaggtaacagttaaagcaataagttgttcttgttttaacaagaatttttggagaacttttctttcttcctgatacagaaagttttccaaaacgggaaactttcgggcatgaaatttaaatgaagtttgctaaagaatcagccagatagctatgatatgccctatgcttccgcccagacaaaacaggtggaaaacagcatgtgtgtaaggttttcgcaacgaataaaatacggctcccatgatgtaggaagcccctcctccgataagccaccagaaggcgggagaagctccgatggcggagaggcagtccatcaaaggtttcagggctaccaggatggcagaacccattccgacgaagcagactgtttcaagattactgtgttctttcagctttttaaaagccagtatgaagcctacgatggccgacagccatacgaaagcgaatattccccagccccagccaccggcatggcgcaataccaataaggtaaacggggtataagtgcctgctatgtgcaggtagatggcgccgtggtcgaatttgcggagaagttctttacggctgccgggtcttgaaccgtgataccaggtcgaactgatataggatgccagcattcccgccaggtagaccagcacacaacctgccgcccaatggggatgtgggttggtaagtgctttttccaacagaaaatatcctgcggtgatacctaacagaatacctgcaccatgactcagggtgttggataattcttcgccgtgtgaatatcgcttgttctccattcgtgtgtatataggtgatgtggtagcaatttaataagatgaccgcagatttgagagtttcgacacaccctcttaaaatctgcggtcatcctttcctttttagaagtatcttgtatcaggcagcagatttataccagatgtccgatccattcttcgcggtcgcccggcaacaggtcgattaccggtacttccaccatggtgtagcatcccggttgctgcttcatcgaagcgcgtgccacgcataccagtacctgtgcggtcagtgcgggattgttgatgcgcatgttgaattcgaacaactgattctgggtttttcccgatacacctttgcgggtcaggtttacaccgtgtcccatgtccaagagtgcatccacgctcggcacttgctttacgtgggtttcgtcgttcacgaaataagcgtccgatttgattgcggctgccacgtcttcaaatttatatccgtctttcagttcgatgtataccatgcggcggtggattcccgttcctgtggggatggtcattgacaaagccgctttcactccgtcgattgctttcacggctaccgtgtggcccatgctcatacccggaccgaagttggtgtaagtgatgcctttcggagcaatagcctcgagcatggtgcgtacgatggagtcgcttcccggatcccatccggccgagatgatcgataccgccccgtgttctttggcacaagcacccagttcacggcggagatctacgattccggtgtggatatcgaaactgtccactgtattgattcccattgcgaggatttcttttgcgtatttctcaacgctgcgggtcggagtacaaagaatagccacgtctactccctgaagttcctttatatctttaactactgcgtaatcattcagttcagccggtttgttctcggcaccagcacgacgaaccacacctgctatctcaaaatcgggagccgcttggagggcttccagcacataacgaccaatattgccataacctacgatggctgctcttacttttttcatctttttattggttttgtttaacacatttctttatttcggttgcaaaattagtcattttctttgttttcaggtctcttaggggtgttaaagttagtttttgttattcaaggttcgtgaagcacaatatttattatctttgcgttctgattataaccattatgatagaatacatcaaaggcgagattgccgaactgagtccggcaaccgcagttatcgattgtaacggattaggatatgccgttaatatatcactcaacacttattctgccattcagggtaagagcagttgtaaactctatatctacgaagccatccgcgaagatgcttacgttttatatggctttgtcgacaagcaggaacgggaacttttcctgctgctgatttccgtttcgggcattggaggaaacacggcccgcatgattctttccgctctttcaccggccgaactggtaaatgtgatcagtaccgaaaatgccaatatgctgaagacggtgaagggtatcggactgaaaacagcgcaaagggtcattgtcgatttgaaagacaaaattaaaacgggtgctgtggctgctgccaccggaggagtgaccggtacattgcttccggccatgaatgcggaagtgcaggaagaagccgttgccgccttgacgatgctgggctttgccgcagcgccttctcagaaagtggtgcttgccattctgaaggaagagcccgatgctccggtggagaaagtcattaagctggctttaaagagactctgagaacagttcggcagtataaggaggcttataagattttctgatacatcctcaaatccagttttttgccgaacttttccgctacctgccggatgtttgcgcaacactcgaagccacatctctcaaacaggcgtatgctggcttcgttttctcccgaaaccagtgccattatattgctgaagccttcttgccggatgatctcttccagccggagtatggtttgttttccatacccctgacctgtgaactccggtttcaggtagagggtcagttctaccgaaatgcggaaggcttctcggggcttgaaacgtgcgaagtagcagaatccgcagggagttccttcgggagtttcaatgatgaacgaccggtagacgggatcgcctacggggatgtagtttttcagttcgtcgatggaggcgcagtgtacaaagtacaccactgtcgtgtggagggtgtaataatcgtagatgtcttttacaaaaggcaagtcgttttccgtgagcgttctgagcgtaatatccattgccgtaaagttcattaattgccgcaaatgtagctaatcttatcagaaaagaagtacatttgtttccgtaaatcaacactccaattcatgaaattgcaaaaaatatatcgtcaacagtggatggaagcccatccacgcatgcaatcggcagataccgatcagtggtacgtggattttgccaacaggctgttgcccgtatttgagaagtcggagcttaccggacagatgattcataagaaccgggctgttctctatttcacctggtatctggaagattgtgtgaataattccggtagctggaatacattcatccggttgcataaacagttgtatggacgtttcctgcctttttacacactgacagagtcgtatgccgatgatgaaataaatcccgaggatgtatcttttctgctgtggacgcttctttctcccgtcacggatagttctccgtctccttggaatccgtttgacagttctctgcttcagctcgcatccgatgtatatgcggtgctcgatgcccattttgaacaggctccccttaccggtgatgaatccacggagtggtttccggatgtccgtgccttgttaccccctccgggtcctgttttggatgtcttgccggaaatgaatctcccccgtgatgtagcgaacttcctgagtgcttccggaggaaaacagattgtatatttaaaagactatgttgatttgcgtcgcttctgtgtcgatgcgttgaagtgggctgatgaagaagattcgttaatgcccgagttggccgatgaagaagattttgtgttttttgccaatccgaaaggtgtcttgctggctcccaatattgccgcttgtttccgcgacgaacgaaatccggaatataatctggagattgccgaacaagaaggggccgaattgttttatattccgggactttgtcccatcgacttgttgcactatgccatgcagcacggcttattgccggaggtcgcttttcctttcggggatggcaggaggctgttgcacgagaactgggatttcatagcccgcaggtatttaggtaaatattataatgaagatttttatgaagaagagcggaaatagcagtgaccgtccgggtagcggacgtcccaaagcttcgggaggcaagaaacctaccggtaagcggatcggaaagtcgaaaccctcaaaagccaataaccagctgaaccgtagggtgaaataagttgttatctgttataaacaggttttattatgaaatgggaaagtagtttgatggaacatctccaatggtcggacacgataaccaaccgggagagtaaagagaggttggcccgtatgattgccatgcgcgtacaagaaggcgaggtcattggggctggctccggatcgaccgtatatctggcattgctcgctattgccgaaaggatacgtacggagaatctgcacgtcaccgtgattcctgcttcgatggagatatcgatggaatgtgtccgcttgggcattccgcagactactttatggatgtgccgtcccgactggaccttcgatggagcagatgaagtagatcccgaccgcaatctgatcaagggaagaggcggagcgctgttcaaggagaagctgctgataagcagcagcaatcgtactttcattttggtggacgaaagcaaacaggtttcttttctgggaagccgttttcctgtccccgtcgaagtctttccgatggctttgccctacgtagagagggaaatccgggcaatgggtgcttcacgtacccaactgaggccggctaaaggtaaagatggccctgtgatcaccgaaagtggaaacttgattctcgatgcctggttcagcaatattcattcgtctcttgaaaaagaaatcaagtcggtgacgggtgttatagaaaacggactgtttatgggatatgatgtcgaggtgatggtagcaaaataagatcagaaacggttgatagtacgaaaactgaagaggatgtatcaaaacccaccacagagtgacacagaggtgattttaagttgctgattattaataaaaagactctgtgatactctgtgctactccgtggtgaaaagagttatgacacatcccttttagcttttgttgcctacaagttcatcgcatttcctccaaggactcccagtatggcagatgccactgcgatcattacttttaaaattgtgttccagtttgatttcttcatttttctacacctcctttcatgtgattctgatttatgccgttgggtcatccacaatgtctccgtcaccgtcttttcccgtttcctttccttccagtgcggctttgatatcgatgaattcgattttatcaccggcccgggtcgatgtcaggttcggacgtacgctcgacgacggacgaaagtttattttcaccgccattatgtttttggccgtacagtctttttccgcatccacccctttggtgcgtgccgaaaggctgaatactccgaaatcccggatattgaccgactgcccgttgtagagtgaggtacgcatcgcctctacaaaattggtgagtacacttttgatatctcctaatgataacgaactcttctccttcatttcgtacgcaatgctttccaggcttgcgctttgacctaaagtgaccagttgcggataaaatttctctatagcatcgtaagtattcgataaactccctcgtataatgggtaacgtatgttcataatatcgtttattcatgtttttcaagcgatggcagagggtggaagatggaagatgagggtggaagataaacaggctgaaaacgcgatcttccaccctattaactaaatgataatcagacaaaaagattgaaaaaggtggaagatggaagatagaaatacatttcgcggaggagaggagaaaagcggatgggagatgaaagatacaaaaagaaaaaagggaagagatcgggaaagagtgaaacgggacgaaaagaaaagataaaagactaatgttaaaagcacattttgccataatttctctcccgcccaaaagcagggcatgttctaccaaagcatatgaaagcagttatagtaacagacaaaaactttctttcatcgttttccagggcaaaatcagctaattatgactctttcgcaattcaagcgcaaaggtctttcaaaataaacaagatgtaccgtcataaggtagttctaagacttctgtcataaggaataaaagaacaaatacaccagcaaaatcaacagaagggacaacaaaaccgaactttaaaaatatccccaaaggagcatctgtccatgtaaatcttgcctttcattcattaaaagtatcggttaacagccaaaaaagattcataaccggaagagatagcaatcttttagggttccacaacgatttcatttcatctttttttcgtatttttgtcccaatatgcaccttattataaggagagcaacgacgaataaagaaacaatgagagtaattgacttaatacatagcaacgaaaaaacagccttctcttttgaaatacttcctcctctgaaaggtacgggtattgagaagctgtatcaaaccatagatacattacgagaatttgaccccaagtatatcaatatcactacgcaccgcagtgaatatgtatacagagatctggggaatgggctttatcagcgcaatcggctacgaaggcgtccgggaaccgtagctgtagcagctgctatccagaacaagtataatatgacggtagtacctcacattctgtgcagtggttttactcaggaagaaactgaatacgtactgctcgacctacaattcctgggaattaccgatctgttggttctccgtggagataaagcaaagcacgaatcggtttttacccccgaaggagacgggcatcatcatgctttagagttacaggaacagatcaataatttcaataaaggtatctttgtagacggttcggagatgaaagtaacaaatacccctttctcttatggagtggcctgttatccggaaaaacatgaagaagcacctaacatcgacatggatatctattggctgaaaaagaaagtggaagccggagccgaatatgctgtgacacaattgttctatgacaacaagaaatactttgatttcgtagaaagagtacaccaggcaggaatacacatcccgattattccgggcatcaaacctttcaagaagttatcccaactaagcatggttccgaaaacatttaaggtagaccttccggaagaactaacccaggaagcactgaagtgcaaaacagacgaggaagcccgcaaagtgggtatcgaatggtgtatcaaccaatgtaaagagctgatggccgccggtgtacccagtatccacttttactccatcggagcagtggacagtattaaagaagtagccaaagcgatttattaaactatgtttttcagagacgtcatcggacaagaggcagccaagcagcgactgatacaagaagtcagcgaaggacgcataccacacgctcaacttttctgcgggcctgaaggtgtgggcaagtttccattggcattagcctatgcacgctacctgagttgcacgaaccgcagtgagacagacgcttgtggagtctgtccgtcgtgtgtgaagttcaataagctggttcaccccgatgttcacttcgtttttccggtagtaaaaaacggaagaagtgatgattacattgtggaatggagaaaactggtactaaataatccctattttacgattaaccactggctaaacgaaattaacgcagaaaatgcacaggcggtgatttacaccaaagaaagtgatgagatcatgaaaaagctcagccttaaatccagcgaaggaggatttaagattaccattctttggcttcccgaaaagatgcagcaagcttgtgccaacaagttattaaagctgctggaagaaccaccccagaaaacgattttcttactggtatcagagaatccggaattaattctccaaacgatactgagccgcacacaacgtttcaatctacgcaaaatagacgaacaatgcattgccgacgctttacaaaacaaatatggagtgcagcaggcgaccagtatttcgattgcccacctggctaacggaaactttatcaaagcgcttgaaaccattcatctgaatgaagagaatcaactgttttttgagttatttgtcagcctgatgcgcctttcttaccaaagaaaaatccgagaaatgaaattgtggagcgaacaagtgtcaggcatgggacgtgaacgtcagaagaacttcctggagtactgccaacggatgatccgggagaatttcatctacaacctgcatcggaaagaattgacttatatgacattagatgaacagaacttcgctacacggtttgccccttttgtaaacgaacgaaacgtgatgggcatcatggacgaactgagtgaagctcaaaaacatattgaacagaatgtaaacgctaaaatggtatttttcgacttctcactgaagatgatcgtactgttgaagcaataactttaaaataaagtatatggaatttaaactgcataatgggagcggaggcctttgctgtaagagctgttcccgacaagataaaaaactaaatacctacgattggctggccgacataccgggcaatgcggaggagagtgacatggtagaggttcagttcaagaacacccgcaagggatactaccgaaacagcaacaaaatcaaattagagaagggagacatcgtagccgtagaagctacaccgggacatgacatcggcaccgttaccctgacgggacggttagtgccgctccagatgaaaaaggcaaactttaaacaagatgctgaaatcaaacgtatctaccgcaaagccaaagctgtggatatggagaaatatgaagaagccaaagccaaagaacacgccacaatgattcgtgcgcgtcagatagcggccagcctgaatttggacatgaaaattggcgacgtagaatatcagggagacggcaacaaagctatcttctactacatcgctgacgaacgcgtcgactttcggcagttaattaaagtgttggctgaagctttcagagtacgtatcgaaatgaaacagatcggtgcgcgccaggaggcagggcgcatcggaggtatcggtccttgcggacgtgaattgtgttgcgccacctggatgacaagttttgtgtctgtatcgaccagcgcagcaaggtatcaagacatttcactcaatcctcaaaaactggcaggacagtgtgctaagttaaaatgttgcctgaactacgaagtagattgctatgtagaagcgcagaagcgcctgccttcaagagagattgaactggaaactaaagacggaacctattatttcttcaaagcagatattctcagcaaccagatttcgtattcaacagacaagaatttcgccgcaaacttagtcactatcagcgggaaacgggcattcgaagtgataggactgaacaaaaggggcatcaaaccggatagtctattggaagctgaacgcaaaccggaacctaaaaaaccgattgacctgttggaacaagaaagtctgacacgttttgaccgtgaccgtcgccgtaacggaaaagatggaaatggaaaagaagaaggtggaaacggaaaccgcaaaaagaagaaaaagaacaataacaaccgtccgcaacaagccgccaatgctgaaacacaaaacccatcgccgacggctatagaaaacaaagagaacagtggagctcaagcggtacaagggcaacaacgcacacgaggagaacgccccaaaaacaataaccgcagcaacaatcagccgcgcaaaaataatgaggctcgtgaaccgcgcaataatgaaaatcgggaaacacgtaagaatgaaccccgtgagcagcgccctccacgcgaaccccgcggaccacgtaacaacgaacaacctaaacgcaccgagaaaccccagggaaatgaaaaacctgctcaagaatagcatctacatgcttctcatgacatggatactgactgcatgtgacgataacactgtgtatcactcatatcaatccacccctcaaggtggatggaaaaagagtgatacactctttttcaatgtccctttgaatgactccctgatcaatctgcgattgtctgccggtgtacgcaacagcagtaattatccttatcagaatctggacatccttatcagttacaatctggaagattcaactgtatggaaaacagacactctgaagtttactctgactgaccaggaaggtaaatggaaaggaaccggctggggaagtctttaccaatcggctctccccttaaaagactgctccatcaagcatcccggtaactatacttttaaagttgtacacggaatgaaagatgaacaaataaccggaatcattgatgtgggactgaaaatcgagcacttataacctcctgctacgtcctgcatcaatacgcagaaaaataaaaagcagaatagtaaatccccataaagacgaccccccataactaaagaaaggtaacggaataccaatcacaggagtcagaccaagcaccattccgacattaataaataaatggaaaaggaagatactcacgaccgaatagccataaacccgtccaaaagttgaggtctgccgctccgataccgctataagacgcagtatcaatgccaggaaaagtaagaggacagcagctgaaccaacaaatccctgttcttcgcctacagtacagaaaataaagtctgtatcttgttcaggcacatatttcaacttcgtttgcgtaccgttcagaaagcccttgccggtcaatcctccagaaccaatcgctatcttagactggttaacattataaccggcaccagccagatcctcttccatccccaacactacctttatacgaatctgctgatgaggttcaaggatattgtcgaaaacataatcgcttgagtagagaaaaccaatagatcccaaagcaaacaatgctatcaggagataagcacgttgccgctcgctcagagacaagtaaagcagatagcagataaccaccacacaaagtccccactctacccaaaccagattaaaaggaacaagatactcagaaacaagataggcaatcgacaatgcaagcaaactaccacctataatattccgcacaggctcccatttctttctatacacccaaaccatggaaccagcaaacaaaagtatcatcatcaaaacagcaaattctccgatcggtgtaggtgtgtcggcaataaacacctgatcaaaacgaatacctaccacaaaatatactactgcacatacccctgaaaacaaaacaactccgggcataccttcgcgatacagcatcaagaaaaaagcaagatagaccaatgccgaaccggtttctttctgtaacacgatcagcaacatcggcaacagaataaaagcaaccaaaggcaaaaagcatttccacttctttatattaaaagaataggcattcataaacttcgccaatgccaaagccgttgcaaactttgcgaattccgccggctggagactgaccggacctaatattaaccaggaacgggagccttttgtatcaggtgcgataaagatagtcactatcaacagaagaatcagacctatatatacaaggtatgcaaacatatcgtacatccgttcttcaagcatcagaagaatgaagccaagcccgaaagaacagataatccacacaaactgcctaccggcgcgggtagaaaaatccagaaagtcacgatcaccataatcataactggctccacacacactgaaccatccgccgataataaggagcaggtaaataccgatcgttacccaatccaatgttttccataaactaacgctcctcgtttccatacataatcactctattactatattcttctgcacgtatctcgttctcgggggacagctttccttttaaatattgttccatcatcagtgccccgataggtactccgtaaaccgcaccaaagccaccgttctcaacatatacagcaatggctatcttgggattattcatcggagcaaatcccataaagacagaatggtcatgaccacgattctgcgccgtaccggtcttaccacacacttcaacatccggcaaaatggccccagccacccggcaagttcctcccgtaaccgcagcccgcataccggtcaccacatcttcataatgttttcggtcgatagaggtctttctgggcacccgatagatactgtcaagctgttcgtcttgtatttctttcacaatatgcggagtgataaaatgtccccgattagcaatagtagcacccagattggctatctgcaacggagttgccaaaatctctccctgaccgatggcaatactgattaccgtcaatccattccagcgtccacgataagctttatcataaaactgagcattagggatcaatccgcgcttctcccccggcaagtctactccaagtttataaccaaaaccttgagaaaccatgtgatctttccaaacagtaatggcattttgcgaggagccatacttccggtcaccaaacatccggaacaatccccaacaaaaataagagttacatgaagtagcaatggccggtatcaatggcagcggtgaaccatgagcatggcaacctacatgcaggcttccgtaattgaatccatgagcacaaggaaaggccggcgtattggtctgaataattccttcctgtaagaaagtcagtgcttgtgctgtcttaaacgttgatcccggaggatatacccccataatcgaacggtttagcaaaggtttcatcggatctctctgaagcatgaggtgattctttccacgctgacgcccaatcatcagtctcggatcaaaatcaggcgaggaaaccatacaaagtatttcccccgtttccggctcaatagctacaatactaccgattttgtttttcaataaacgctctcccaacatctggagatcaatgtcaattccaagtttcagattctttccgggtatcggacgtttatcatacttcccatccatataatgcccctgtatgcgcccatgagcatcacgcaacaatacttccactcccttttcaccacgcaaaaaagattcatacgatttttcaatgccttgcttaccgatatagtcgccacggatgtagtaatcatcattttctatgtctttcattgatacttcaccgatatcaccaagcacatgggcagcagagttataactatattgtcgaatggtgcgacgctgtatatagaatccccggaatttaaatagtttctcctgaaacaccccacactcttctgccgaaagctgagacataaatacctgattagtataacgtgaatatcccggatttctacggcggtctttcatatcactcataattctcaggaactgcgcacgggtgatattcagcgtctgacacaaatcaagtgtatcaaggttctcaacttcctttggaaccattgtaatatcataagcaggctgattaaacaccaacaatttatcattccgatcgtacatcgccccacgtgacggatactgaattttatttaagaaagcattactgtcggcattcttcttatagtcatccgtagctatctggagtgaaaataaacgcactaagtagatcaggacaatagccagcgctactccaccgatcacatattttcgtttctccagcacataatcttttgccatatctatctcctcactccttcaacagccataatacaagttatagtcaaaatggtgctcgacaccacccttaacagcaataacggtatgctggtaaatgagaagaactcaagagtaagcaacataagatgatgtacaaagacactcaccaccagatatttgagaaaagaagcaatccccatacttttcaacgaaggtacaatgctgtccaaagtatcgcggggagtaaacaaacggagaaacaacggacgtagaaaagccagtaacactgtcgccgccgcattcatacccggtgtgttagaaaagatatcaatggcaagacctatgcaaaagccccataacatcaattcgtttcgggaagtaccggaattaaactttaaaataaagtagacatataaaaaaggagtagccacaccggcaatatgcacattattcaggatcagtacctgaagcaagatcagaccgacaaaccatcctattctatgtatatagttgataatcattgcgccaaactcttttgttccaattctttttgttcatgctggccggtccttgcaatcacacgcacttcactcactttaccaaaatccgttgccagctttactttcaacaaataagagagcccgtcattcgaatcggccatatcatctacagtaccaatcatgatcccttcaggaaaaacagtagaataaccactggttaccactgtatcccctaagttgaactctgcatgacggggtaaatctttcaaataagcatatcgggaatctccatactcccatttcagataaccaaaatattcactacccacaattttacaactaatactggacttgctgttcagcaccgaaatgacccgggaataatgagaagaagtatcgtatacgataccaacgactccgtttccgtcgacaactcccatttccgggcggatcccatctttcgatccacgatttaaagtgatgtaattatctaccagattgagactgttattgatgacccgcgccttaaaaacctggtaatccgtattaggtaaattgcggatactatttaattcggtagagtctgataaatgccttcccagagcatcctccagattgtgattctgttgttccagttccataatgcgatccagcaaatcttcattgaccgattttaaatggaaataagaagtaatccctccggatacttcatacactttgccggcaaccgcattagccgaactgaaataaacactgtgttgatagtgattaaagcgaaataacaaaacaaaactgatcacctccaataaaatgaagaggaaccagtgattatatttcaagagaaagttcagtaaattccgcataaagacatataagttacaagctacgaactacgagctacaagtatatgcagctacatttatgcactgccagtaacttatagctcgtaattcgtagttaattatttatctcatcaagaatgagaaacggtctacattcttcaatgcaacacctgtacctttagccactgcatgcaacggatcttccgcaatgtggaaaggaatattaatcttatcagtcagacgtttgtccaagccacgaagcagcgctccaccaccggccagatagattccattgtgtacaatatcagcatacagttcaggaggcgtattctccaacgcgctcaaaatagccgtttcaatttttgaaattgatttctcaaggcagtgtgctacttcctgataacataccggcacttccatcggaagcgcagtaatacggttcggtccgtgaacaatataatcttccggagcatcctcacccagttcggtcaaagcagcacctacattgattttaatacgctcggccatacgttcactgactttaacgttatgttggcggctcatatattcctgaatatctgctgtcagatcgtcacctgcaatgcggatggagttattcgaaacaatacctcccaatgaaattacggcaatctcggtagaaccaccacctatatcgacaatcatatttccttccggtgcctctacatcgataccaatgccaatagctgcggccataggttcaaataccagataaacatcacgtccaccggcatgttcggcagagtcacgaacggcacgaagttcaacttccgtactacccgaaggcactccgatcaccatacgaagcgacggagaaaaaagacggttgcgagtatttacctgtttgattaatccgcgcatcatctgctcgcaagcatagaagtcggcaatcactccgtcacgtagcggacggatggtacgaatattctcgtgggtcttttcgtgcatcagttttgccttttcccccacagcaatcatcttgtctgtccgacggtcaagggccaccaccgaaggctcatctactacaatcttaccaccggtaattatgatagtattggccgtaccgaggtccattgctatttcttgtgtaaaagagaataatcccataatgaataaatttctaatgcgtcgatatgccagtgtgccctaacgggttgtccggcatacaacaagtttttaattagtgcttaaagtggcggatacccgttgtcaccattgccatgccatgttcgttgcaatagtcaaatgtcaactggtctttcaccgaacctcccggctgaataacagctgtcacaccttctttatccgcaatttccacacagtcggggaaagggaagaaagcatccgacgccatcactgcaccctgcaggtcaaatccaaatgacttagccttctcgatagcctgcttcaatgcatccacacgcgaagtctgtcctacaccgcttgccagcaattgtttaccttttgccagtacgatggcattcgatttactgtttttcactatcttattagcaaacaacagatcttcgacctcttcgggagtaggaattttatcagttaccgttttaaggtctaccgttgtttcaatattcaagtctctatcctgaaccagtacaccattgagcaaagaacggaattgctttctcggcaatttggcttctttacgaaccaaaataatacggttctttttctgcccaagaatttcaagtgcatctacatcataatcaggagcaatcactacttcaaagaagattttattaatctcttccgcagtctctttatcaataacggcattcgtgatcaatacgccgccaaacgcagaaaccggatcaccggccaaagcatctttccatgcctcaagcacagtcgggcgggaagccagtccgcaagcattgttatgcttcagaatagcaaatgtaacgtcatcaaattcatcaatcaagtctacagcagcattaatgtcgagcagattgttgtaagaaatttcttttccatgaatctggtcgaacatctcgtccaggtttccatagaaatatcctttctgatgcggattttcaccataacgcagcgccttctggctgtttgcagaacaacggaaagcagatccctcctcggcatcaaagtaattgaaaatagccgaatcataatgtgatgaaactgcaaatgcctcttttgccatccagcggcgttcttcaagggaagaagtagctccatgctccatcaacatatcgagcaatggtttatactgggcctgagaagcaacaataatcacatcgttgtaatttttagcagcggcacgaatcaaagagattccgcctatatcaattttctcgataatagcagcttcatcggcacctgaagcaaccgtagcctcaaatggataaagatctacaatgacaagatctatttcaggaatttcatatttttcaatctgctggatgtcttgttccagtccgcgacggcaaagaatacctccgaaaatcttcggatgcagcgtcttcactctgccacccaaaatcgaagggtacgaagtcaaatcttcgacagccttacagggatagcccagtgattcgataaactgacgagttcctcccgttgataagaactccactccttcttcgtgcagtttggtaatgatttcatccaaaccttctttgtgataaaccgataccagtgcggtttttattcttttagactcagacattgatttgcttattaagtatttggtgcgcaaagttacaaaatattgtttatcacacgttataaataaggtgtgaattaataataaaaaagcgctgactcacaattaaatgagtcagcgcctttcttattatcagtttatttgcaacaatctattaccaaatagatacccgtttatccactggcaagtacatcggatctttttcagtaatattgaaagcctcgtaccatgcaccaatctgaggtagtgcgccatctacacgccatttgcctaatgagtgcggatcaatcttcgtaagtttcaggatttcttccggacggatattaccagcccacacatttgcgtaagacaggaagaaacgttgttcgggtgtaaatccattttcatttttcaaaggtgcagccgccgttgcttttttgaatgcctggtaagacacttgaagtccaccgtgatcggcaatattttcacccaaagtaaactctccgttggcatgaaccccgggagctacttcaatgctgtcgaagaagttaaccatcactgctgcacgtgcttcaaagttcttggcatcctctgccgtccaccagtctttcaagttaccatccttatcatactgacggccctgatcatcaaatccatgagtcatctcatgtccgataactacaccaatcgctccataattgaaagcatcgtccgcattcatatcaaagaaaggatattgaagtattccggccgggaaacagatttcattcgtcgtcggattgtaatatgcatttactgtctgcggagtcatgtgccactcctctttatctaccggcttaccgtatttggcaatcatttcattgtagccccactgactggcgcgctcaatattagcccaatacgaatcatcctttatctcaagtgaagagtagtctttccatttatccggatatccgatctttacatggaaagttgccagtttttccatggccttttctttagtctcttctcccatccagctcagttccctgatacgttcgcccagagattcttgcagattcttgaccagagccaccattctttctttggccgcagcagggaagtacttctccacatacatctgtccgacagcttcgcccaatgaactgtcaactgtgctgacagcacgcttccaacgaggttgcatttctttcttacccgacatggtacgaccatagaagtcaaaattctgagccacgaagtcatcactcaggtaattggcggccgaattgatcagattccactgcaagtacagaatctggtcctcaagcggtactgtatcgataatggcattcacttctttcattgcatcaggctgcccgatattaatctctttcaagttattcagtccggcagtcgagaaaaatacatcccatgcgaaagagggatattctttttgcaatgtttccaaagtcttcttgttatagttggcatgcggatcgcgtaattctacttgtgaacgtgccgaccgggccaggcgggtttcaatgttcattacagctttcactgcttttccggcagtagtctcatcatatcctgccaatcggaacatcttacctacatgctgctgatatttatcacggatctcttttgtctgtgcatcattctccagataataatcccgttcgcccatacccagacctccctgcatggtgtgtaccatgttttcattgctattcatgtcatcagcgctgacataaaaaataaaatagggatacataccattcttttgcatttccacgatcaacggataaatctcagttttacttttgatagcacctattttatccagttcgggtttaatgggagcaacgccttccttattcagctttacgctgtccatagcaatattataaagttcacctactttctgtgcaatgctgcccgcttcgtgtttgcccgctgccaaaccttcaatcagcccgcgcaattgccgacgattgttctcggcaagcatatcaaacgaaccaaaacgcgaatattcgtctgtcagaggatggtttttcatccatccgccacaagcgtactgatagaaactggtgcccggcagggcagttgtgtcaaggttggcaaggtcaatgccggacgtaagtacggcctctttcttactgttgcatcctgttgccatacaacagattgcaaggattggtaaatacttaattactttcatacacttaaaaaactattatttttcattcatctcctccagctccattgaaacacgttcccactcttccaccgtgtggtcaagttgttgtttcaacttctggtgttgttcgtaaagtgacatatccgaagcaccatcgggggtagccatcttctcttcaaggatagctatagccgattctgtttgttcgatggcagcttcacagtctgccacctggcgctccagtttctttatcttcttattaaattctttctgtgcttcgtaggacagtttattttcggataccccctcttcagctccttcctctttcttaccgcctgtaggtgagacagacaaaggattgtttttctgaagttcgttcaggttctctatttttttcttttgaaggaaatcatagatacctcccaagtgctctttcactacaccaccaccgaactcatatactttagtcgcaagtccgtccaggaaatcacggtcatgactgacaataattactgtaccgtcaaattcgcgtatggcctctttcaatacatccttcgaacgcatatccaaatgattggtaggctcgtcgagtatcaggaagttcacaggttccaacaataattttatcattgccagccgggtgcgctcacctcccgaaagcacttttaccttcttatccgaggcttcaccaccaaacatgaaggctcccagtatatcgcgtattttgagacggatatctcccactgccacccggtcgatcgtatcgaaaacagtcaggttctcgtcaagcatctgtgcctgattctgtgcaaaataacctatctgtacattatgtcccaaggtaagcttgccttcataatcaatctcgctcataatacatttcacaagggtagacttaccttcgccgttctttcccacaaaagcaaccttctcaccacgattgatggtcagattgacatcatggaagacaacatgcgatccgtaagttttcttcacatcttcgcagatcacaggatagttgccactacggctggagcagacaaacttaagcctcaacgctgagttatccacttcgtccacttcgatccgctctatcttttccagctgcttcatacgactctgaacctgtacggccttagttgctttatatcggaaacgctcaatgaaagcctctgtatcttcaatctgcttctgctgattctcgtaagcgcgcagctgctgttcacgacgctcctgacgcagaacaataaactcatcgtacttcaccttgtaatcatatatctgtccacaggttatttcgatggtacgggtagttacattattcaggaaagcccggtcgtggctgaccagtactaccgcattggcacgggtagataaaaaattctccagccattggatactctcaatatccaaatgattggtaggttcatcgagcagcagtacatccggtttgcggagcaaaagttttgccaactcgatccgcatacgccatccaccggaaaattcactggtaggacgattaaagtcatcccgactgaagcccaatcctaagagggtacgttctatctctgcatgaaagttagtccctcccatcattagaaaacggtcgttctcgtgcgtaaaacggtcaataagtttatgatactcttccgaatcatagtcagtgcggtcggctaactcctgattcatcctctccaaatcggcttgaagctcgaaaatatgttcaaatgccagttctgcctcttccatcacagtgtggttatcggcgagaatcatcacctgcggcagatagccgatcgttacatcacgcggaatagctataacaccccgtgtcggactttgcagtccggccaggatctttaacatcgttgattttcctgcaccgtttttaccaaccagggctatgcggtctttcttattgatgacataactaacgtcctcaaacaatggtgtggcgttaaattctactgttaatccttctactgaaatcacttctttctataaataagggaattgaggcaacaaagatactcaattatgcagactgcgaaaaagaatctatataaatatgcatcttcggaaacagcaataaatatccggaatgacaattcaatcgattcttccggacattacccaaagaaataatgctaccgcaccactattctttttttaaagaacgtatcaaactgaccaactgaccatttgaagcgataccctgaacaacaaaagttaaccggctttgtcccggatcactgaattccaactgggagccggttttatttaacggaagagcaggaagccaatatatcgttttgcaattattttcactgttatttgccgacttctgcacgatagggtagaaaggcgaataaaattcacgtttcagctgataccccatgggacgaatcatcctaaaattagatgctttcttaccaatagtgcctaaacccgattttgtactaatcagaatagcgccattcgatgccttagatccaatatatgccatttgggcagcatcttttaccaactcgacggattcgacaatggatacaggaatagcaacaagttcggaataagaagtttccagtccatctaccatcaatagagccggaggaggagtagaattcatccccatgcataaccgtgttatataaaagaaatctcctgcctgtgaatcgactgcccgccccactccgggagtattaatcaataaatctttgatagatgaataaggtgaaagggtcatttcgtccacatgataagttttattccaatcggagtgagccattaaagactcgattgcataccgtttctttttctcaatcttctgggtggaaacaacaacttcgtctaaatattgctccatagaaaaaggatcggtagaagaccgctgaaacatatccacgcttgccggagaaggatcatcaccggattgctcggcaacaatcggctcgtccatctccgcacgaaaccaatccgcataaatgggaagagaagaatgcacaggcggaatggaatcccggtcgactaacagcgccacacccgtaccccctttttccttacgcgcctgaagaatgaaatgcgtaccttgaggaaaagaaagactgtcgaaacggaaacagcccaaagcgtcactcctcgtctgaagcataaccgttttatcgaaagagaataaagtgacaaccacatcagggatgcacttcttctcggaatattcggaaaccaccttgccactaatgcactgactactctctaccaaaaaggtactgcgggacggaacaaggctgtatttcacccaaccctgagtcagcatcaacaagtccaacagatacgaggtacgggagtcatcactggaaaaatagaaagagggatcctcaacatatccctgaagatcggaactcagaagaaaagaggaaagaatattgaccgtggtatcttgaagagcataacggtcgtcggtaactgaaacagagagtgtaccgctcaacggctcaccggaagtatcacgaagccccatagtaatatcccaaaatgaacgtcctttatcctctttcaggcaagcggagaaatcaacatcagcacgcacggaagggttccaattgaaagcggtacggccgcttaaggggacgcccgaaccatccaacaaaacaaaacggagtacacccggaggcagcggagagcgaggtacacgcaatggggtggagccggaaaaagccgcatgtaaaagaacactatcccgatattcgacacgaagggaataacccgaagacacgacagtacctgaattcagacgcacccaaaagtcatccttacgaatatcgacacggagagctaccgcagaaaccggttcaaccttcggaagggcgaaacgtaactctttaccctcacgattacgacataccgctgtataactatcatcgggaatcggttcaagattgaaaaagcccataccccgatgaaccgaactcagtgtggtgacggtatctccacgctgattgagcacaaagccttgaacatctgtccccaaaccgtcagaactcaaagccttgaaagcgacacgactgacacaacccgagggaagatgtccgccttcgggaaagaaagagacgtgataggaagccgccatacgagtcacactgtaagtattcgataaactccctcgtataatgggtaacgtatgttcataatatcgtttattcattacaaaagtaacatcacatttttagaatgaaagggggagtttatcgaatacttacatagcatccgcttttcgcggatcctttctcgcgatttttttgtatggaactgccattgtccgataattttttatggttaataattaagaatgcatccggaaggtcggacgagctctttccctttcttccggtatgtcaaagataccgctttgtaacccctgttttgtgcttgttgacgtgggttgaggcggtatggataaaagatggaaaatcaatgaatgttttgtgaaatagtatgacttctgctatgatatgtcgtttgtttttgttatctttatgctattgtaaagttccgattatttattaatttaaaattgaaaaacatgaaagatttagaagatgacgagagagagtttcctatccgtgtatatacaaaagtcgagttggctctgctttatgcaccccatttgtctgaaaatgccgccctcaataatcttagccgttggatgcggcacaacaaactcctgatggctgcgctcgaggaggtgggatactataaataccgccattcatttacgcccaaggaagttcgtctgatctttcgatatatgggagaaccgggagcataaaattagagagaaaccaataccggtattggttcggaggatttgataagaagttgaacttgtgtaatttatgcacaagttcaaaaataataggtattgattttaatcaaaacagctaatatctttttgtcaataaaacgccaatatatgtcctgccccgtaacaatatatgtaatcgaaataacatatattgttacggggcatttctcttctatctccttctttccgatacttttaaaacggtaactcttccatctcctttcctttctcccttttcctgaagttttcgctcacctcctgctggctgagttccactacggcatactccgtaatgccatggacgtttacacgcttgccgaaggcatccctttccagaatctgtaccaacacctgttgcgtttgcgcgttggcttgtgtccgtccgtatacagatagagtggccagtattgcggcggcgggtttccatttcacctcaaagtccttttctcctgccggacggaagtaaacatacaggttctcttccagtgggtctttcatgcggtggcgttcgtttcgggtgttgatgtcgtctatctcgtttccttcaaaccaatagcggaaaccgtcttctatcagttgcaccgcctgtgcgtatactcctttgtggtctaccggagtgcggtagtcgatggtttttacgggaatgaccaggaagcgccggtttcctccgtaatctctgaggaactgcatgttgttggtgctgccgatgaacgatgccctccggggataaagctgcgcctgagtgtcgtataccttccggatggtgacgttctcctgtccgatgatccgtttgagttcggcgatgtctcctgtcttcacaccctcaaactcctccatgttgatcagcagccgggtggatagcagcaagaggtcatctttgtttgccgggtctatcattccgttgcggtaatattctccgagttcggggggcagcaggtgccgtatccaggtactttttccttttccctgcgccccgtgcagcaccagggcttgctggttggctttacccggttggagcgccgaggccaccatggctacgatccagcgccggaatccttccctccagaattcctgatcctccgcctgtatggtgtccgccagtttcccgatgtggtcggttgtcctgtcccaccgcacgtttcctccgaagtagtcggtaaagggattgaactccggtgtatagtccgagtcgatgaccgacttcaggctgttgagcggatagacgatgccctgtctgctgatgttcaggaagatggagttgagatccttgttccgcatggcgtagaatgattttccctccttcgttttggacaagtcgcacatctccagtcggtcgagtaccgtgtttcgcctgaaagcataattcttgttcagatagtctatcacctgttccacgggcggtatcttttttttctcctctgcccgttccgttctgtccgtatatgtgtaggcgttcgcgatgggggtgtctgtatccatctgtccgtcctcccctaatttcactgctgccagacgcttgacttccgcctcttcaagtccctttcggaaacatttgtttcccagggtgaagaggaacgaattgcggtttccctctgtgtatttcatcagcctgcgggtagagctgaggcatttgttgaattccatgcacgtgtaggcgctgacttcccctgttgggtccgttgcgggctcttccttctgccttcccctccgtgcaggttcgggggcttcgatggtgaatgtccgttgcgggatgtgtgccacccgccggggagagtaaaacgccctcgggtcatacgaagcgaagacacctctcgacaagtcctttccgctggtgtccacttccgtctccagaagtttctcgtagtgtttacgggccagttcgtacattcccgcgtgatactgctccaaccggctgtaagtgattgccggtgtccggaagaacgcgtttcgccatccttccgcttcgaggcttaccggataggcgagcaccttgaatccgtgttgcttggcggtgaggaaacaggcgagtgtcgcttcgtctgtttctatcagggcccgtatccggtccagctccttttcgggcagatggtccaggtcgatggtgatgatgtcattgtatgcggcgatactatgcgccagcctgcattcgtggtagtttgccgtgacggtgaagtagtccagctgtcgttttacgttctccgcttccttggttttcccttcactaataagccttcctattttctcaatcagggcggcatagcgactgctgcgtaccttttcgattaattcattcagggagcatctcccttttactttgctgaagcccctgtaagtagtaatactaatgttttccatttttctgtcttttttaaagctcgacgtaagtgtctgcggctgtaaaattagggatgattttataaaccttgttagacgttttctttgaagaatgtctttatttcgtctaagatgtttgtttccagatctttatccgttccctttttctcctctttcagaaattttagtgtgttaaatatttctgtttcaatggattgtactgacatctcctttgtgggggtttgtttctgtccgaagtatagcatacggtacatgatatgtgccaattcacggattcctttgcgctttttcgttcctttttgcaggtaattcaaccataagaaaaagaggataaccagctctctgtgagtagttatgtcgagtttttccggtttcttttccagtatttctaaaattctcttactctcgtcagtttttccgtttgtaattactacataaggaatgtcttctatgttgagaatcattccttcattcggttttttttgctcattttgtctaatgtgatttattgttacgaaggcaaaattaactgttcttagtatataatccgttatatacgcgtatattgtttacttttaattgatgttttaccctgtcatggaaacaggttaagtatacctgacctgttttcatgacagggtaaaatcagtttaaaaagagagtattatgcgtgtacgcgtgtacgcgattatataaagggcgttggtgaatagggggattttggtgtaaatagaaaagagtatgtttcaaaaaacgttcgtttgtttaaacaccatttttgacagaattttaaaatctccaaaaagaaaaattcaaaaaaagaaaagctaatttaagagttttaataattgattgattcacagatagataaaagtaccattaaaagagaaaacaaatttatttataaaaatattttgctataataaaaatgctgtttacctttgttccattgaacgaacgttttttgaaacatcaatgacttctaattcattcgttcatagagctttatctctgaaattcttctgtttcttggaaatggtcaatttcagggtacttacataacatttcatcgttctcctgctgtgataggggagagtcttgagatcgcatgaatgcaagtaatactgatattcgcattacattatctgaccgggaggtactttcgtactccggtgtccccaaagaataccctttagtgaaggaatccgacaacatccattggtatgctgtgcgagtcacctacagccgcgaactttctttgaaaacgtaccttgacagcgaatccatcgagaatttcatcccgatgcgctacgagtatatcgtgaagaacgaacgccgagtgcgtaaactggttcccgctgttcataatctggtattcgtccgttcgtgccgtgaacgtatcgaccgtatcaaagaagagatgggtatatcccttccgatccgttatatcatggatcgggaaagtcgccagccgattgttgttccggactcccagatgcgcagcttcatggcggttgccggcagttacgagcagcaactggtttacctggagccttccgctgttgccttccgtaaaggccagcgtgtgcgtgtgacgggtggtctttttgccggtgtcgaaggtgagttcatccgtgtgaaaaacgaccgtcgcgtgatggtttccattcagggagtgatggctgttgccaccacctacatccatccttctctaatcgagccgctcgatctttaaacagtaaaatagcagacagtaaatcgtaaatagtaaatattcccatgaactctttagattctcaaattaccgctttgtacaccttggcgcacgaacttctgtatctgggttccgatggcagccccatctacagcgaccacttcagccggttgaacggtgatgtactcagccgtgccaacactttatatccccatcatggctccaccgacgaggaagaagcccgtttgtgcctttcgcttctgatgggttataacgcgacgatctacaataacggtgacaaggaagtccgcatccagcagatcctgaaccgttgttgggaagtgctcgaccgcctgcccgcttctttgctgaaggtgcagcttctgacttattgctatggcgaagtatttgacgacgatctctcccgtgaggcacacagcatcatcgacagttggggagagcgtgccctttccggcgatgaatgtgagattgccgaacaactccgcagccttgaagagaatccttatcccaactgggaagtagaggagtgaactcttttctttttctacacaacactgtatataacctaaatcccctttgtcttgaatatccttttcatcatattggcttttgtcatctctgcttcgattgcccggcttatcattccccgcatcctgcttatctctttgcggaagaagcttttcgatatgccgagtgagcgcaaggttcataaacgtgccattccccgtttgggcggtgtctctttctttcccaccatcctgttatcctcttgcggtgtgttcgcacttcgcatcctgatgggttatgatgttcctgccctccgtgcggtgtacttgctgcccgagtgcatgtttctggtctgtgggatgactttgctttatctgacgggtatcgccgacgaccttgtgggagtccgttatcggcagaaatttgtgatccagatcatctgtgcctcgtttttccccctggccggcctttggatcaataacttctacgggcttttcggcctgtatgcccttcctgcctggataggtatgccttttacggttcttctggttgtctttatcaccaatgccatcaatctgattgacggtatcgacggtcttgcttccggtctgagcagcgttgccctgcttgtcttcggcttcctgttcatgcagaaagaactttggacgtacagcatgctcgcctttgccacgttcggtgtgctggtccctttcttttactataacgtcttcggcagtgcggaacgtgcccgtaagatttttatgggtgatacgggcagcctgactttgggctatgtgctctctttccttgccatcaaatacagccagtacaatccggatgtcaccccgtataccgaaggtgctttcgtgattgctttcagtacgctgattgtccctgcgttcgatgtgatccgtgtggtgatggttcgtgttcgcagtggcaagagccctttcgaaccggacaagaaccatattcatcataagttcctggcaatgggtttcacaccaagaaaggcgatgataacgatcttgctgatttcttgtgcatttagtgcggtgaatattctgttggttccggtggttgacaacacggtgatgcttttggcggatattgctgtgtgggtgggactgaatttatggtttgacagggtaagagataaaaaacagaaataagaaaaataattatacgatatgtctcaaaaagatctattgaagcaacaaattctcgatttaacccgggaatactacaaagaggttcacggacaatcccaattctttgaacccggtaagagttttgtcaactacggtggccgttatttcgatgaccgcgaactggtgaatctggttgactcctcccttgatttctggctgaccgccggtccctgggcccggaagtttgaaatccgttttgccgaatggctgggtgtgaagtattgctccctgaccaattcgggctcttcggccaaccttctcgcctttatgaccctgacctcgccgcagttgggtgagcgcaggatcaggcggggcgatgaagtgatcacggtagcctgcggctttcccacaacggtgaccccctgcatccagtatggtgcggtccctgtttttgtggatgtcaccatccccgagtacaatatcgacgtgacgcagctggaagcggcattatctcccaaaactaaagcggtaatgattgcccactctttgggtaacccgtttgatttgcaggctgtcaaagatttctgtgataaacataacctctggttggtagaggataattgcgatgcccttggctctacttatacaatcgacggtgtagaaaagaaaacaggtacgatcggccatatcggcacaagtagcttttatcctccacaccacatgacgatgggagagggcggtgctgtctataccgatgatcctctgctgcacaaactggtgaactctttccgtgactggggccgtgactgctggtgcatcgggggtgttgacaacacgtgcaaataccgtttcagcaaacagttcggcgacctcccggtaggttacgaccataaatatgtctattcccatttcgggtataacctgaaagtgaccgatatgcaggccgccatcggctgtgcccagcttgagaagctggactccattgtcgaagcccggcggtcgaacttcgcctacctgaaagaaggccttgcgggtacatctggccttatccttcccgaagcgcagaagaattccgacccgagctggttcggcttccttatttcggtgaaggaagatgctggcttcacccgtaacgacctttcccaacacctggagagcaggaagatccagacacgcaacctgtttgcgggcaaccttctgaagcatcccgcctttgatgaaatgcgttccacgggtgagggctaccgcgtaatcggcaatctggaaggtactgattacgttatgaatcataccctctggatcggtgtctatccgggcatgacccgtgccatgctcgaccacatgatcggtacgatccgtgactttgtctcttcccgtaagtaatttccggttattaaccttcaataatctgtcaagcataatgaaagccgtcattttagccggtggcttcggcacccgcctgagcgaagccactaacctgatccccaagcctatggtggagatcggtggtaaacccatcctctggcatatcatgaaaacctacagccattacggcatcaacgatttcgtgatctgctgcggttataaacaatatatcatcaaggagtatttcgccaactatttccgtcataacagcgatatgaccgtggacctttccaacaatacgaccaccattctggacaaccattccgagaactggaaagtcacgatggtcgataccgggctgaatacccaaacgggcgggcgtatccggcgtgtacagaaatatctcgggaacgaacgtttcctgctgacctatggtgacggtgtcaccgacctgaacatcggtgataccctgaaggctcacgagtcttcgggctgcctcctttcccttacggcctacaaacccggtggtaagttcggcgccctgcagctcgatctcgatacggacaaggtcctctctttccaggagaagcccgacggtgaccgtaattggatcaatgcaggctattttgtgtgtgaacccgaagtgttcgattatatccctgagggtgactccaccatctttgagcggcagcccctcgagtctatagccaaggcgggccggatgcacgctttccgtcatacgggtttctggaaaccgatggatactctgagagacaatacagaattgaatgaaatgtgggatcagggagttgctccctggaaagtgtggtaagccgtatgggaattgatatatttgataatttttatcggggcaaacgcgtccttgtcactggtcatacgggttttaaaggtagctggctctccatctggttgcatgaattgggggccgaggtgattggtgtggcccaagacccttttacggctcgagacaatttcgtactttccggtatcggcgagaaaattaaggccgaccttcgtgccgatatccgcgatggtgagcgtataaaggctatctttcaggaatatcaacctgagattgtttttcatcttgctgcccaacctctggttcgcttgagttatgacatccctgttgaaacctacgaaaccaatgtaatgggaacaatccatgttcttgaggcagtccgttctacggatagcgtgaaggtaggtgtgatgattaccacagataaatgttacgagaataaagagcaaatctggggctatcgtgaaaacgagcctatgggcggttatgacccttattccagtagcaagggagccgctgagattgctattgcttcatggcgtcgctctttctttcaccccgagcaatacgataaacacggaaaatccatcgccagtgtaagagctggtaacgttatcggtggtggagactgggctttagaccgtatcattccggactgcatcaaggctttggaatctggagcggctatcaatatccgaagtccgaaagctatccgtccctggcagcatgtacttgaaccgctgagtggctatatgctgcttgcgcagaagatgtggagtgatcctacgagatattgtgaaggctggaacttcggtccgagagccgagtcaatctctactgtatgggatgtggctacgaaagtagtgaataattacggttccggtgaacttcgtgacctttctgatccgcatgcgttgcatgaagcgaagttgttaatgctggatatttcgaaggcaaaattccgtttaggttgggaaccgaagatgaatattgagcagacggttgagttgacggtggactggtataaaagataccggaaagaagaggtatatgatgtttgtgttgaccagatagttaattttatacagaaataagatggaaacagtattcctgattggagggagcggctttatcggcaagaacctggcacaatacctgtctcaaaaatatcatgtgcatgtatttgataagtatattgatcagcccttctttacatcttgtccctccattgaaacaacggaactggatttggtaagtcaacggatcccacaggatgtaccatcacctgattatatcataaatcttgcttcgatagtgacggcggagcggaatatgtccttgtttgatgaactaatttcgtccaacttaaagatccttctcaatctgtatgaacgtttcaaagaagaatcctcgttgaaactttttattcagttcggcagttctgaagagtatggttctgaacaatctccctttcgggaggaagaccgtgagtgtcctaactctccgtatgccttggtcaagcaattgacaaccaatacatccatgatgttgtatcggaattatggctttccgataatggttgtccgacccggtaacttgtttggtccgcttcagaataaggataaattcatcccctatgttgtcgggcaactgagatccgggcttcctttgaatgtttccccctgtgaacagaaaagagattttatttatgtggatgacttcgcttgtgcaatagaatcccttttacagaaccatttcaaatgtcttggggagattgtgaacgtgagtagcggagaaagtatttctttgaaacagattatcgagcattgtaaagcatatcttcactcgtcatcggatgtgaattacggtgctttaccctatcgggagaatgaagctatggatcttaaatgctccatagctaaactatcatcaataacgggatgcaatatccattttgataacgaaaaaagactaactgattatttaaaacaataactatgaagtatttgataaccggcggatgcggttttatagggagcaatcttgcagcggaggtgctaaagagaggtgaagaactctttgtcttggacaatttatttcgttatggcagcagctcaaatcttgagtggttacgtacgaaaggtgactttacatattatccttatgatacccgcaataccaacgatgtcgaaacggtaataaaggaggtgcagccggattatatttttcatttggcgggccaggttgcgatgaccacctccatctccaatcctcggttggactacgaaacaaatgctttgggaacattcaatttactggatgctgtccgtaagtattctccggattctgtaatcctgtattcttcgacgaataaggtttacggtgattttgagtatttgcatttcagggaagagtctacccgttatgtttgcgaagaataccctaatggctttcctgaatcgatttctttggattttcactctccttacggttgttcgaagggttgtgccgatcaatacctgctggacttccatcgtatctatggtttaaagacgattgttttccgtcattcttccatgtacggcagtaatcagcacgctacctacgatcaggggtggattggctggttctgtcagaaagctctggagatcaagaaccatactttgcaagaaccttttacaatctcgggtaccggtaaacaggtccgtgatgttcttcatggtgaggatgttgtgaatttgtattttacagcaaaggacattgacaaagcttatggcgaggtgtttaatattggaggtggtatagaaaatagtctttctttgttggaactgtttgatttgcttgagaataaacttgatattgagatgacctatactcaattaccttggcgagagagtgatcagaaggttttcgtggcggatattgaaaaagctacgaggattttgggatggctgccgaaggtatcgaaagaagcagggatagagttgatgattaattggttaagaagttcatatggacttggttaataggttgttgtttaggaaaataggggttgatcaagctattctatttactggattagctcgcattgtacaggcaatagggggactagtggtcgttgttttagttacaaaaaaattaaccaatatagaacaaggatattattttacatttgctagtattttggctattcaaattttctttgagttaggttttaataatattttgagccaatatgtggctcatgaggctattaatatacgattagaggagaatgaatttgttggatgtagcacatcaaagtctaggatttcgtctttattgcatttttctgttaaggtatattctactttatctatttgtttgttttttgtgttatctttagttggatatatattttttatattctgttcgaaagataatattgtagaatggagaatgccttggctgatgctatgtttgatgactgctatatatttttttatatctccttttatagcttttcttcaaggattaggaaaagttaaagagattgcattaatgcagtttatacagcaatgtgtatctgttatcggcttgattggtacccttcttttgggtggaaaattgtatgcaggaggaattgccttatttttaggagttttggtctgtacttgttttgtttataagaggtttagtaaaatattatatgctatttatcgtaattcggttacttgtgttatatcttataagaaagaaatttttccttttcagtggaagattgctttaagttggattagtagttattttatttttcaattatttaatccagtcttatttgctactgagggtgctgtagttgcagggcaaatgggaatgactttaagtgtacttaatgcaattatgtctctttctgatagttggataactacaaaaattcctttattttcaggcttgatagctgccaaagaatatctaaaattagatcgtatttttaaactgactatgtttcaatcattttttataaatatatttgtgttatttcttttcatatttggtttatatataattgacatatataaaatttctatatcaggtcatttgttaattgatcgttttttgccgtacggattaactgtgatgttgatgtttacaattgtgttgagacaattatatggaggatgggctatttatcttagatgccataaaagggaacctctattaatacaatcagtaataattgcaatcatgtgttctgtatcaacattatttcttggagccattagtggaattaatggaattgtaataggatatacattcttaacattatgttccgcagtatggatatatataatatttttacaaaaaagaaaaaagtggcattatgcaagtatttgaagataaacttttaaccattgctattcctacttataatagacctgaaaaattgaaggatcaagtatcgttacttctaaagcaagtaactgatcaggttgaaattcttattttagataattgtagttcatataatatttatcagctattttcgaaagaagaaagacagaggattcatatcgtgactcataaagtaaatgttgggatgcctactaattacattcgttgtttagagtatgcaactactgattgggtatggactctgtctgatgatgatcctgtactgccagatgcgattaatagtgttttatcggttataaagaataactcagatgcgatttctatttgtatgaattccacctttgatgttagttcttatagttttattgaatttgttactttattgaaatctcataaaattttctctttacatttttggatgtctatttgtatttataatttgtctaaattgaggccttatatatcatcaggatgtaatgattctacgacaatgattggtccactcctcgtcgttcttgagtatttgagaatcaatggtaagggacgttgcgtgttaacttcacaggaaattatattatcatctaattctataacatcatggaagaaagcagactttttaattcgtttaagtttggtatatgatatatttagaaatgatcgtaaagtacttcaaaaaacattgttttatggtatgacaaatttaagtttatatgtccttatccaggggattagggagaaaacagtaagtaataaggatggaaaatatatattgaaggagttgttattcaaaagtggatatatgtattttattaataatttctttattctttatttaaaggctgtatgctatttgtatttacctatttctattatggatagaattattactttaaaaaagaaataactatctaatgagaaaacttaatattttatttgtttttcacgtaccttttattgcacaaaatggcggtgttgagagagtgacagatatattgtcacgccatttgattaatcgtggatattctgttttttatttaagtagtgaacaaagatgtagtaactttgattttcctgtaaagcagttttattttccaacatctagctattattctcaaaagaatatagactattataattcttttttactggaaaataaaattgatattgtgattaatcaaaatggttcagagaaagcggcttttttatatttaaatataaaaaatagaagtaatgtgaaaattatatcagtaattcatactaatcctcttgtgggatttcgacatcatcaatatgcattgatacctttatgggtgagtttttctttacgagatgtctgtgaatatttgatgaaattattattattccctctcagatatatatatagaacgctagttcaattacataaattgaaatctcaatattcatatgtaacacaaaatagtgatgtagttcttttgttatcaaataattatattaaggatatgtcatatatatgtcctagttctgtttttaaactgagaagtatacccaatccattaccatattcaggaaatacattatattgtaaaaagaaacaaatactatatgttgggagatttggagttacagaaaagcgtccagacagattattgaaaatctggaagagaatatataaacaatatttggattgggaattgatatttgtaggatatggtggtcttgaacgttatatgcgtaattatgttaagcgtcataaattagaacgagtcctttttgctggtcaatgtgatcctaggatctattatgagtcttctgctatattatgtttaacatcttcatatgagggatttccaatggttttattagaggctatgcagcataaagttattccaatggcatttgatagctttgcttcagtccgagatataataattcctagagagactggtttgttagtaactccattcaatttgaatgaatatgcaaatcaattagctgaattaatgtctaatccttcccaaagattaaagttagctgagcaagcatattcttttgtacagaaattttcggcttccaatgttgtttctaaatgggaggatttatttgttgagattatggataaaggttaagaaaatgatggaaactattgatatattattggctagttataatggttcaagatttatagaaaatcaaatattgtcaattattggtcaaacatataaaaattggattttatatattcatgatgatggttccagtgataatacattagatatcattaagaaatacgaaaaattggattctcgtattaaattaattgatgatggagtctctttgaaaagtccaggggctaattttatgcatatgcttggagtgtcacaagctaaatttatctgtttttgtgatcaagacgatttatggcttgaatataagcttgaagtgttactatctgaaattatttctaaagacaattctattccgcaagttgtctatggcaatggttacacatggtttccggaaagttattatatggggtgtaattctgcatctgtttatcctcattctttacaagatttgtttttctttaatggtgggtatcagggtgcatctgccatttttaatataaaaatgaaagaatgcatcgataagaaatatacttatatagcaatgcatgatcaaattttaaatttggcaggggtccttttcggtaatatacattacattaataaatctttatttttatatcgccaacatagttctaattttactccccatattgtccaaaatggaatagaaagatttgatagaattattcataatttgaaagtgccagtactagaggaaacttattaccttggaattaaatctttttatgatattcataagtccaagatgaagagccgtgatatagaactatttgattgctttcttgaatatcctaataaaagagcgttttggagatttatttcaatattaaagtatggatataaggttaataattctaggatatatttattgattaaacttttgataaggccttttcttattaagtctggaaaatattgatataagatgctatatctaactttgataattacactgttacttattagatcttctataaaaaagtatgatagagtatttaatcccaaccgctacaaacacctggtaggcggttttatcgtggggctgccagccctgacaccgtacgcggccttatacgcagccgccatcgcagcctcctcgctggagctcaaagacaagctccggggcggtcgttgggactggacggactggacactcaccgtgaccggaggagcaatcgccgcattgattttcctcgttatctaacaaggggactggcttttatccgtacctttgcaccccggtggagcttcctgatagtccgtgtggtctatcgcgggtacaacaatgcgaatgcgaatggcggcgtgtcgaatgcgaatgcgaataacgatgcatcgaactcgaacacgaatgtcggctcccgtctggaaatctaacaatcggcgtacaacaccggggacgtgtcccctaccgtggtgccgagggaagcaagccacagcaaaagcgcacaggtgcggaaagctgaaaaatcacgcgtcgggtggagtttggtaggctcaagtcagctcgaagaagtcagacccggggaaaggaaggcccttatcttccgtttgtaaaacaatcaaaaaaaacaatgctataatgcacaggcaaggatatatagtggaagagattgccgattattccaatatggcggaatcgttcaaccaggtcctccgtggctccaaacgaaaaaaaagccgccaaggacgttacctgcttgcgcacagggaagaggtgcttcaggaacttaccggaaaaatcaagacaggtacattcaccgtcaaggattaccgggagagggaaatcgtggagggtggaaaaatgcgacgtatccagatactcaccatgaaggaccgcatcgccgtccacgcaatcatggccgtagtggacaggcacctgaagaaacggttcatccgtaccacctcagccagcatcaagaaccgcggcatgcacgacctcatggagtacatacgccgcgacatgaaagaagacccggaaggaacacgctactgctacaaattcgacatctccaagttctatgagagcgtggggcaggatttcgtaatgtattgtgtccggagggtattcaaggacaagaaactcatcgccatgcttgacaacttcgtaaggctcatgccgcaaggaatcagcatcgggctgaggtcgtcgcaagggttgggcaacctgctcctgtctgtttttttagaccattatttgaaggacaagtacggcgtccgccatttctaccgctattgcgatgacggcgtggtactcggtgacgcgaaatcagaattgtggaagattcgtgatgccgtccacttccaggtcacacaaatcgggcttaccgtaaagcctaatgaacgtgtattcccggtggacgagggcatagacttcttgggatatgtcatataccccgaccatgtgcgcctacgcaagcgcatcaaacagaaattcgcccgaaaaatgcacgaggtcaaatcgaggaaaagaaggcgtgaactggtcgcttccttctatgggatggccaagcacgccgactgcaatatgttgtttaataaattaacaggcaaaaaaatgagatcatttaaagacttgaacgtttcctacaagccggaagacggcaagaaacgttttcccggctccgtggtaagcatccgggaattagtgaacttacccatcatcgtgaaggacttcgagaccggcatccgcaccgaacagggcgaagaccgctgtatcgtagccatcgagatgaatggcgaggccaagaagttcttcaccaactcggaagagatgaagaacatcctcgcgcaagtgagtgaaatgccggacggatttccgtttgagaccatcatccggacggaaactttcggcaaaggtagaaccaagtatgtattcagctgatgaaaaaagtggaaggaaacatcggggtacggttgcttgaatgcataaaccccattaaaaacaaatggcgtgtccgatgggacgtgcagccgggagagaacggatcggccacctacatggaagaggagttcgaccatcgacccaccgaagacgagatacgctccacggtcataacatggcacaaccgggaaactgacaaggatatcctatcaggtttcacctacgagaatgtcccggtatggctgtcaagcgagaaccagttcaactacaaggcggcctacgaccttgccgtgcaaacagcaggggcgactcttccggtcgtgttcaaattcgggacggacaccgaaccggtctatcgcgagtttgctacactggaagacctgacagacttctatacgaaagccatgcagcatatccaaaacacgctggccgacggatggaaaaagaaagatgtatttgatttgtcgctatatgcggtagattaaaaaaagccttcgggggtaaggctgtaaaaaaagcccccggcctgttaaacagtcgtctcacttacttattaacacaaagatacctcttacaggcacgaccgggggcatagaccctcgttcgcctgcaagaggtttttttgtgtacgcttctgcgcataaataagtgagacagtgcaaaagtactaatttttgttgaatatgaaagtaattgagatactgaaattgaataaaggaatgctgaaaacatgccggaaagtgggaatccggatggaagacgtacagtatatcgaactatacaatgactacaacaggctgttggacgaaggcgaaaaggtttcctacatcgtggcagtactggccgaacgttataatgtttgcgagcgaaaggtatacacgctcatcaaacggctgcaaagcgactgtaacccgtttgcagtgtaatgggacagcctccccattgaagagggataacggcgcggtacctttgcagggtatcaaaacgacacaccatgaacaagtattatcaaatcctgaaaaaggtacttgccgacggcaagacacaaaaaggcagaaaaggcgaaagccgttacctactgaacgagacggtaacgctgtcccctgcggaactgctcgatattttcgagggacacaatatcgcacggaagaagctcagaagcgaactgtcgctcttcatgagcggggaaagacaggttgagaaataccgggaagccgggataaactggtgggactactgcggctccatcctcgtgaactcctaccctacctatttcgagaagctgccacctctgattggcaaaatcaaccgggaaaaacgaagcagcaagaactacgtgctgttcctcggttcgaccggcacggaaagcaaccaggcaccatgcctcagcctcgtacagttccagatcgaacaaggcgaactggtcctgacggcctaccagcgtagctcggacgccaacctcggattaccggcggacatctatcacctgtaccttatatcccggcaaatagaactacccctgaaatccatcacaatcaacctcggcaacgtgcatatttacgagaacaacgtcacacgcacacaagaactgcttgccggaaatcctaacgtaaaattcgaattgaacgtatgaaaaagacgtatctgtcagccccgctgccattcgtgggccaaaagcgcatgttcgcacgcaagtttatgaaagtattggaacaatatccggaaagcacggtattcgttgaccttttcggcggttccggcctgttatcacacatcaccaaacgatgcaagccggaagccacggtcatatacaacgatttcgacaattaccacaagcggttggaaaacatcccaaggacaaaccggctgatcgccgacctgcgtgccatggtagggaattccgttccacggcacaagaccataaccggagaactgcgtgagcgcatcttcagccgtatcctccaggaggagcacgagaccggttacgtggacttcatcaccctgtcctcctctttgatgttctccatgaaatataaactgagcgtaccggagatgcggaaggaagccctttataacaacatccggaaagcggactatccggagtgcacggattatctggaggggctggaaatcgtctcctgcgattacaaggagctgttcaaccggtacaaaaacacgccgggcgtggtgttcctggtggacccgccgtacctttccaccgacgtgggtacttacaatatgagttggcgtatgtcggattacctcgacgtgctgaacgtgctatccgggcatccgttcgtctatttcacctcaaacaaatcctccatcctggagctgtgcgaatggatcgggaaaaacaaaaacatcggcaacccgttcgagggatgtacccggatggagttcaacgcccacataaactacagctcatcctacacggacatgatgctgttcaaaaaagaggctgcctgacggcgtttctttgccccctgttgaaatagaaagcctccggcggtaatttgtccgccggaggctttactgtccgaacatggccgtttatcgaagccgtttgaaggccacgcacgaatacacctcgatattttccacgatctcctcgtggttgtggttcgtctggctctccacaaggtcaaatgccatgaaagtatcgccatccatgcacgagagccgctcatgtatcagttccggcaggtcaaacacctccaacgcctcttccttgaacggactgccctcgttggctgcaccggcccagtccgtcacgatatgcagtttcacttccggttcggcccgatattccaccccgtccacaatcgcgttccagcgtatcgggcagaactccacgaacacggcagggcgttcccaattctcctcctgctcgataaactccacattgtggttccacaggtcgatgtgttttatcaagcctccgcccacctccttcagctccttgcagagcatattataaagttcctttctcatttccgtcttatatcaaattcaacattgaaatattccgttatattctcctctatgatttcacggacagccttctccacttcgggagaaacccccaagaaacgccttcggggaatcttgatcatgctgccctcctttttcaaggccatgaacttccagaactccgcctcgccggtcaactgcacggtacgtttgtccttgcgtttctctccattcttcctgcgtccgaaagaaccggtcgcctcgtagtatttatgccaaaagtaacgcttcatcttttttgtcacccttatctccccgccgtcattgtggatggccgcatacggaaggtcggtgtaaaacgtgatgctgttctccgtggtccggctggaaacgctccgcctgagccggccggtatctatcaaaatagaacctccgggacgtgtcgggcttttacgccgctgccatgcctcggagaaaaaagcctgacgctcaaaattacggtcgaactcatctgtcatctccacccggatatcctgcaggatccgggcgattatcttctgcacgtccttgttcatagtcatcgtcattaaagagtaaaagctggcgggtctcctcgtcagctatcttcttgctcgcatccgcgctcgcgttgagtatattgtagaatgtacgttcggtaacggcatatacaggatatacgtaccgccgccagatctcgcggttcggtacaccgcgtttggcatattggtcgtatatcctgtttatctcctccacacgtttctcataacttactccgcgtcgctttgccatcgcttactccttctttggattatatggttgaatatccagttccatcttcgcgctcactatcacccggccgctgccgccacactggggacaagcctcctcggtaatattcactttcttttttctgaaaatccgagaaggaagttcggtcgttctctgtacgacacccgtgccgcgacaagcacggcacaaggctactttggggctcttctctacattctgtatcatactcttcatttttaggattctgtcatacccaacgggatgggcttccacatcccgttattgtctcttatctcagctctgatgaactgcttgctcacctccggctggtaactctcctcgatgatgcgcacgccttccatgaaacgctcgtcaccggtttccatcgctaccttgcgcaattgaacgatgcgcgaggctttcaacgtacctttggcatcacgtgccaacaggcggagaaccatgctcaccagcgccttggtcttttcgtccttggcgaggctttcgatatactccttcacgatggcaattccgtcctccaccgtatcgcggtaaccgtctgtcacatacacgcccaacgtgatacgcttgcttccctcgctgttggtgaatgtgtgactgcgctgatcgtcctttgctttcgtcttgaacaggtcggacttcatttcaaggatggtcttgaaattctccatcaccgtccgcttgctctccttgatgcgctcgctgatacccagcaacaccggaatagagcgttcgatctcctcgtccaccatctgcttatacatctcgcggtcggctctcgccttctcttccgcgactttcttggctttcgcctgacggaaggcatcaaactccgccttctcggtttccgtcattacgacggtctggttcttctcttccataattcaaatcgtttttgttgttaatccatcaattctcatactcctcaccataatctggcgtttccaactcgctttccaacagggcttcctcatatttctcataagaccactcgttcagcctgttgaaaaactcttcccgatcatcccggtccatttccgggaacacgtcaagtatctggttcttgacattctcaagcagttcattaaatctcttatccatatccgtcaatttttaggagctttggtgtctatgagcatataggtcaccgccgccggttgttttacttcctctttctttttttccttgagcccgcccttgcgccggatagagcgcagctttacagccagttgttccagttcgtccgaagagatttgactgaacgcctttcccgcaatccggggattccggcagaagtcattgacacgcgcccagtccgaagtgtcgattcccattttttgcatgagtctcaaacacacgctgcgccaatatttaagttcctcctgcatcttctgacgacgctcgtccacaccggccaatttctccaatccctcacaacaggtcttatattcaagcctcgtcatttcacgaagactgtctgtccggttccatgtatactgcaacacgatggacttcttgaactcttcccggtctccgttgaacggcagcttgttgaacaaagcgtaaaaccgggcgaaattggttacttcctgtgccatatcatcctttcacttttttctccaccgaaaggatagccagacttatcatcataagttttacagactgactgtcctcctcaagcaaatcaatatccgcaaccacaggctcaccgctcatggcgttccatacttgctctacctcttccgtcttcttttggttcatcaaaaagagatacgcatcatactcggaacgatcaaactcaaatacgacctgaactttctgtttttcttccatagttcctatcatttattgttttctttcttcgttacttcatatcctttttctttaagatacgttgccacataatcatcattgccaaggtcattcagcacatcaaaaagataacttgacacataccctgcaacggcatgtgccgatgcataatcaattttttcagagataaactccaccttcttggttctacccaatcctcgaaatgctttttcaatgtcattcataattctatattttaaactgttattcaaacaatactttaatgccgcatgaactcgccacgtcaagttccagcttcgcgcctttactcagttcccagtccttcagcatatagatatactcacaatccagaagcagggcgatatccgcccgcatgtgctctctccaatgggcctcatccggtagcccgttcttaaaaggattgaccggggaaaagcccatatttctcaaattctgttccgcattggcaaacgcacccttgcgctcgtcaatgttatagtgggctattgccccgctgatgtaaaccttgtctttttccatatcacaaattattactcgtttgaatgattccttcttcccacaccacataatagctgccggcctcaccgatggcacggccttgacaatacgccttataaccgaccacccggatcttcatgtcgcagatataacgcaaacggatcgcaccgcctcccatcggctggctcttcttttcctggctgatccagatgaagcactttttcgggaaacgcttcatcaaggctaccgcatccggatactcccattccgacacctgatacgaatccacgatgataaacttcggggatttcggcttctttaatcggtctatcagttcctcataggtctcgtccacaaccacacggaacttgccttgcacctcgttcatcttcaaatattccatacggcgttggaatgtctggttcacgccctcttcataactcaagtacaacacaaggccgtatttgcacagttccttgctaagctgcatcacaaagctgctctttccgctggcactggcaccgctgatgaaccaggaggcattctccgcagggaacccgaaaggcttgttccatttctcgccccacggcaacgtcacccatttcttggcggctatgtctttcggactatatgctcgtttcatgactctttttctattgattcaatcctatatttcagaaaccctttgatgatatgcggaggatggtgtatcgggcagaattgccctacgtgaagcctccaatacgggacataagcatctttccatatttcattttgaaatggtccggcttcctccacaagaccaccttcatttactttgagccataacaggtcttggcctttgtcctctaaaactatcttaaccatttcctatgccattttaagtttctctatctcggtatatactcgcctcagacctccacgtgtcttgcgtacaatctgcgctatatccgcacctgccggggcatttactttagccaccgtctgagcttgggcattcaaaaacgcctcacgctccttgccgtcatcaggtgtcaccttgctgtaacggtctccataacggctcaacatctcggtatagcccactttcttacattctatcgaacggttgatcttttctttcaaaccatccgcacccatcatataccaggcacaactgcgttcggtggcattccacaaagccttcagctcaaggaacgcctcatactgcaaatccccggcctcgtccaaaataataagcggattctcaatggaacggaggtaataagtcaaatcctcgtatacatcgctatatttacctttggcatccactccgaactccgcagctatcttacgcaccagcttcagcttagtcttcacctgcgagcagtcgatatacacggcattcttgtggttctgcacataataccttgcggtaaaagtttttccgatgtttggaatgtcgcataggatagccgacaggctcgactgctgggagaactccagctgggcggttatatactcgaacgtggcggtcttggcaaccttccactccatatcggcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatggttcccactgtcgctgattttcttctgatccacacgccgtgcccctttaccgtaccaacgacccaccccttcatggttcttatgggcgatagttgtcttgaatgcgccgttcaacggttcggcatatttgtcctgagagttcaacggtgcacaaaagcgcacaaacttgaacacctcaccggctttcaggaagccctccttgtacttgctcatcaaatgctgctccacctcgataccggcaggcatcccccacccgttacgctcaatcaggcggaacatatcccggaaacaggcaaccacaagggcttcgtctttatcacggccgtaagcaagccccacacggcactggctcaccatatcgtaggcataataagcatgtacgtattcaccacccttcatgcgacgcggaagatccacgtcatccatcgtaatctgggacaaggagaactctccactgtggcggtgcatgtgtggcatttgctcgtggtagaattccgaccacccacgacgctttttctctatgagtacctggttggccggcttgttcaagatgttgcgaatggtactttcgctcagttctttcggatcaccgttcttatccgtaaaatcgttatggttgaatatttccccggtttccaaatcccatacctccaactcaccacacacaaaggagatatacatctcgtgtacgtcactgccataaggctggttcggcagcaccgtgatgctcagcacgagacgctcggtcttgtaatccactttcctcgcgcactggttaccgaactttccactgataaggcactcataaccgtactgcttgtactcgttcaccttctttcggaaacgcaaggtactcgccggcagatcatgcccgaactcttcgcgcagcgtctcaatggtagtagccatcatgctccaatcatacttctctcccattaactttcgataatcacgactacgattgtacaacttgatacaagtattcagtactgaagcatttatcgcatactttctggcaagctcgtcagaagccttatcgctggactgccgggcagcccaatccataaagaaagcgacggcagcctgatcaagctcgtaattcgatattatccagccacgcaaaagcacggcattgccaccaggatatttctcctcgactttttctttgtaagaggtaggcagactatcaataacaatcaaagctccatttcctttcgctccaccaccacgacgtgctacctttatccggccactggatgccatatacttgtaattcggaacagtcattattccgccatcaacaagttcacgaaacgatatgcaaagtttgttatcgaaaaattccatactcacacctccttatttcaatgcggccgcaaaattttggatgctgtctatattggaaaatgtcacattatcataatgtctcacctcttcccctttataagtcaccacacccgtgctgtcgtttttactgatctctaacaatgcgccgttcggaaaatattggcgtatcacgttatcatggtcgtgtagtgtctccataaccggagccaccgccattacaataccaccacgctcacgggcggccttctggatcctacggatggtatccgtatcctgttcaaaacgcagggctttccaaaccgtcacgctgcttacgttgaaagccttggccaaaaactggcgatcctcacttgttacatgaatatacttcttcatatctcacttgattttaatatcctaattcgttatatttgttgcgtttaaaaaaaataaccgacttatgcctcaaaatccgacatcactgcctttcttggtatcttacgctgatactctctcatcagcgaagagcagacctctaatccaaacagccctgacagcgattgcatctcttcaagaaattgactgcgtgtgtatcgacaacataacgctacctgacgatattgcagaagccggcgctcgacttggagcatacacgacagctgatcttgtctggttccacttctcaaagcattcactaatgacgcaaaaggtgttcgagaaagccgttcgcggactctttgctcatagtcagttgggaagcccggtatgggtgtttcttctgccggagaaataccgacatctttacccttctccgtggaattgattgttcttttcataagtcactcattttagtgtctatatctgagggagtccagggaatcgaaccctggcgcaagaaccatacactcccgtgtgtctttccacaccgccacccgtctcttgacgccttccgggttgtcacgctcggttttccgttatccttcaacactttcacctttctctataacttcaagaagcattataaacttctcacgtacagactgcttcatctccagttctaatgtatgcgccagatttgaagctgcactggtactgttcctgcgaatgcttccggaaagaagactgtcagtcaaactgcttatcttgttttctataaacaactttgcttcctcatgactgccaacggataaaaccgttttcaaagcgcggtaacaagcaagctctcgttgtgttttgtacatctcttcagcataccagcaaaagaagtgttcatagtcctcgttcatctctttggtgtacttgtcagcttgttgtaccaaagcgtctatatggttcttcacaaaactgaatacaaaatcccagcaatccattttcttattttccataatctcacttatttaaattcgtttataatcggtttcaaactcacgccgtagcagctcatcaagcgccggatgagattctttacataaaaatcgggagcggaaaacacaatcccggtctcttcagtgtatctgaaactgataccgtccatcatcaacacgtaagctactttgtgcttcacgctttgtgtctgccattctttgatttcttcgttcattttctttaagtgctaaaattcgttattctcgacctataaatcttatcttttgtcctgttttccaagttccgtatgaacttagcttttattactatttttttatttcttaaatcgtgttctacttaagttcttcgagaactattgcatttttatcctttatttatttttattattgggtcctgtttacattttgattatttcatgcttttttatcattttgtattttctatctcatctgtattgctggttttagcacccgaaccaaagatctgaggaaaaaaacagctgtgttgctgttaaagaaagttgtatttaataggataaagcctccaattttgtgtatttgctcgataaaacaaacgatatagctctttaatgatatgtattaagtgaattaacgatgatttatgatagtagaaatgtaaacgggaaaaattagtaaatagcttcttaaagcagatttttgaactctaactttttaagatgttaacttcgtacaaataaagaattaaggttttgtcaacaggatattaacttcgtacagatagagaattaatttcctatattcaggaaacgaataagatcctgcaataaaatgtatttttacttaaaagataattctatattgcataataatggtatttttattcaagaagaaattattatagcatctttttaaagaaagtctgagttagctaaatataaagatcctctcccttatgtcaacctaaaatgaattttactatcttttttatatttctataatcattattatttaaacacatctttttatattcaaatgcgctcatttgctataaatcctctatttttattttaaaatttgtattgtttctccctaaaaaattgtatgtttgcacatcacaccgatagatttatgaccgagaaagagcttattgtatcattaaaactgggggacgaagctgcatttactgctctatacagaatgtattggcctaaagttcacaacttttcccgtttatacctatcttctatggccgaagtagaagaagtggtacaggaggtcttcgtaaaattgtgggaggcacgtatcttcttgaaagagaatgaaagcttcaaaggatttctatttattataacccgcaatataatttttaatcaatttcgtaaaagtttcaatgaaaatgcgtataaaacgactatactcagtagtgcagaagttgaatatgatattgaagatgaaatggatgcagccgatcttcaggcctatataaagaaattaatttctgaactgacgcctcggcaacaagaagtatttcacttaagccgtgaagagcaccttagctataaagaaatagctactcgactgtctatcagtgagaaaactgtagagcgacatattaatgaagccttaaaatttttacgtaaaaacatctatttatttatcatatttctttctctataataataaggtatagagagcttatttcatgatttcccttttattttaaagattttaaattttctttgggggatgttatggtgttgcgtgtatttataaatagataggtaataagaaggtaataaagatgaaacaagcgacaaaaggaaataagaatataataaagaagctgctgaccgatggcctatcgccggaagagcgagaaaaacttaataactataaatttgtgaatcaggcaatttatagtcaatgggaacagacttctgatatgtataccgatgtcgataaggaagaacgaatgctaacaaacgttatgcaccaaataaagaaaggaaaaagcggacgttttaggcaaagcctacatcggtatagctgggtagcatccatagcattattgctaatttgcggaacattatctttaatgttattatccagaaaatcagatccaaaagtttggtatgttctgaattcaggacgccaatccatggattcagtgagactggcagatggtacattggtgatgttgaatgctggaagtcgtttgacatatcctaaagagttttccggagaaaagcgggaagtaactctttcaggacaagctttttttaatgttcatccggataagggacatccttttgttgtaaaaaccaagaatatggatgttacagctttagggacagcatttgaggtttttagttttgatggtgacgaaagtgtagaaacagtattgctcaatggcaaagttagggtagaacctaaggataacaaagagcaaattaaaggagaatacattcttcgtccgaatgaaaaattgacttgccaagcaaacggtgatgtgcgtatagatcatgtagatgctaattcatattctgcttggcgtattggaggacgattgagtttcaagaacgaaacattggccatgattttacctcgtttagagaaatggtatggtcaaaagatcgattgctcacagaaagtggctgatcattatcgctttacattcacattgcgaaatgaaccattggatctgattctgaatattatgtcgcatagtgcgccattaaattataaattaataagcaatgactactatgttctcgaagaacttaagtagaacacgattttacaccctaaaaagattcaaataagaaaaatggaaaaaacagtgaaacatgttaatcaagcacgggattcttaaagggcaacgcctattatttgttaaatttaaattacaatctaataattatggtatttatgaaaaaatgcaatcaaaagtggtttaatccacaaaaagtaaaaaagcaaatagcaattgctgttgctattagtttagtttgtgcaatacctatcagcacatttgcacaagtactcaaattctcaataaaaaagagtaacacttctatccaatcggtattacaagagttagaaaaaggaagtgaatatacttttttctataatgataatcaagtgaagttagataaaaaagtttctataaatgtagaagatgctccgatagaagttgttctaaatcagatatttgaaaattccgggtactcttatagaatagtagagaatcaaattgttatatatacaatccccaccacaactgcgcaacaaacggttcaacagcaaaaacaacaaaaagtgaccggtgtagtaaaagatattgcaggagatcctataataggagcatctataatagaaaaaggatcttcttcaaacgggactatcactaacgtgaatggcgaattttctcttatagtaacaggcaatgaactccaggttagttacattggatatattcctcaaaccattaatctcaaaccgggggtaagctcttataatgtaataatgaaggaagataccaaaacattagatgaagtagtggtagttgggtatagcacacaaaagaaagagagcttgactggtgcgctacaaacagttaagagcgataaactaaaagatattactaccccttcagtagaaaatatgttaaacggaaaggttccgggagtatatgtagctccagggtcgggacaacccgggtcaggaggagctgtcgtgattcgtggacaagcaactttaagtgggaccactgctccattatgggttattgatggagtgattgttggttcaaatgccggtgctttgaatccaagtgatatagaaacaatgactatcctaaaagatgctgcttctactgctatttatggttcacaaggagccaacggcgttattctggtaacaaccaaaaatggtaaagcagaaaagatgacagtaaatgtctctgcaaaagttggtatcagtaagttagggagaggaaatatggaaatgatggatggagcggagctatatgattactataaatcattctcaaatcaggaagcgattactttttcacgttataatgatgaactgcgaaattgtaatttcgattggtttgatttggctgcccaaacaggagttacccaagattacaatgtttctttatccggaggtaatgagaaaatcagatctttcctttccatcggtgtctatgatgaagaaggagcagtgaaaggctatgattacacacgatataacttccggttaaaaacaacctataacccctttgaatggttgagtataaaacctgcactggcaggatcgcgacgggatattgaagataaacagtatgatgtaacttccatgttccaaagactgccatgggatagtccttttgatgaagaagggaatttggttcccaatagatatacaggatgggtgaacagttctaatagcaattatctatacgatctgcagtggaataaatcgaactctaccaattatgaatttatgggtaatttagattttgatattagaattactgactggctgagtttttcatccgtcaataactataaatacataggctataattacagtgaatatacagatccgcgctcaagtagtggagagggagtagatgggcgtatgcgtgaatatcaaactaccactgtacgtcgttattctaaccatatcatacgttttaacaaaatgtttggtaaacattcaataaatgcgttggctgcttatgaattcaacgattattgggctaaagcaacagatatgtatggaataggatttattcccggtttcgaagtattggacgtggtagctaaaccggagaaagttggtggtagtattagtgagtgggcggtacagtctcttttatttaatgcaaactatgcttttgataataaatatctggcacaactatcgttccgtcgcgatggagcctctaatttcggagataatgcaaaatatggaaatttcttttctatcagtgccggatggaacattaatcgtgagaaatggtttcatgcctcttgggttgatgtattgaaattacgtatatcttatggctcggtgggtaaccgaccaagttcactttatccccaatacgatctctattcagtatcttctaaatataacgaagaatccggagccttgatatcacaattgggcaataaagaccttacttgggaaaagacttatactacaggcatcggagttgacgtagctttttttgataatcggttgagagcaagttttgactggtataataagtacacaagtaatattctatatgcagtacccatttccggattagtaggagtgacaagtatgtggaagaatattggtgaaatgcaaaatcaaggatttgaattgtccattggcggtgatattatccgtacgaaagactgggattggaatatagaaattaacttgggacataataagaacaaattaaagaaactctataagacaaagaacgctgagggacaatttgtagaaaagccaattattatttcagatggaacatcgattgcaggtacagccaaaagagtattacagccaggttatccatgtgatacttattatctgaaagaatgggcaggtgtaaacccggaaaatggggcacctcagtggtataaaaccgtagaaaatgaagatggaactttatcacgtcagaaaacaagtaattattctgaggctgatcaagtgaaatgtggaagttcatctccagacatctttggaggatttagtacggtactccgctggaaagatattgatctgaatgcagtatttggctactctgtaggagggcaaatctataattattctcgccaggaatatgattcagacggagcatataacgatcgaaatcaaatgaaacttcaaaagggatggaatcgttgggaaaaaccgggagatatagctacacatccagtggcttcttatagtaatacgagtaagtcgaacagttcttcctcgcgctatcttgaaaaaaatgactatcttaaattgagatcattatcaatcggttacaacctaaaattgcctcaatattatattaataatatgagaattttcttcactggagagaacctgttctgtgttacaaattactcaggcgtagatccggaaattccggccagtgatggttctgtaataggtactgcattaccttcggtttatccaactgtacgtaaatttatgtttgggcttaatttaacattctaaaagtaacgattatatgaaaaaaataataactctactatgtgcggttgccactttaaccgcttgtgacatagacagacttccttatggttcaatgtcagccgaacaaataactcaggatcctacctcttcattagagtcacttgtaaatggatgctatgcacaattaaaaagttggtcggatcctatgcatcgtttaggggaatatgcgggtgataatatggcgaaagataaatcatcaacggatgcctttttcgattttatttcttattcccgcgatgctgataattatcgtctacaaagcttttgggactccggatacaaagctattgcacaagcttcgaatattattaaaatgattgatgaaggacaaagcaaaaccattgattatcaactgggtgaatgctactatatccgtggtatgatgtatttttatcttggacgtgctttcggacgtccttattgggacaagccggaaggacatatgggagtccctattgtaaacggtacgccagacgatgtgaataatcttaatcttcctgatcgttcgactgttcaagatacttatgaacaagctattgatgacctgaaagcggcggcccgattgatggaaaatggagaaaccaaacgagaaggtcctgcatatgcatctaaagaagcggcatgggccatgttgtctcgtatttatttatttatgagtggaacttatgaagcacccaatagtgaaaatgcccagttggccattgattatgcaactaaagtcattgaaagcaccactgatgaaggtggactgaaatatgagttgctctcccgtgaaaattttatgcgatataatacattcatgccggaaaataataaagaatctatttttgtagtaaaaatcatggcatcagaaaagccggattattggaattctattggtggaatgtattcttatgctggacagcaaggctggggagaaatgtatgcgagtgccaaatacatggatttattaaatgaacagggacgtaacgattggcgtcctgacaagaaaaagattgtagatgcacgagcaaatttcatttcaccaagctacatcacggatagtgatggtaaatatgttgaagtattccgtttcataaagaatgtatacaacaaaaacaacatacatacaggatatacatatgtacaattgcccgtttctaaaagaggtgacactgtaacttgtaaagagggggaaactaattacacattgtcattaataaacagtagtgaagaaaaatattcaatcagctattcagacggtcaaatctatcacggtgttattgattatgaaatagaactctcaagcgggcaacccaaattctatattctcaaatgttcgaatgaaggaactgcaagcggagaagctgaatctcaattacattctcctgtcatctctcgtttaggcgaggtttacttgaatcgtgcagaagcatatgccaaaaaaggtgattatcctcatgcacaagcagatctgaatatcattcgtgaacgctctttacccggcggaggttataatgacttaaatgcttccaacgctaaggcgcgaatagaaaaagagagacaattagagctggcctatcaagcagaacgtagttatgatgtatttcgcaattgtgaaacattaactcgcaaatatcccggagtacatgatgccatgcttgaaattcctgctacagactatcgagttatttattttattccacaaagtgctattaattcttatcccggaaccttaacacagaatcctaccagtaattagaagcgtttgacgaaacgtacttcaatagatttttaataaaaatgtgaggcttatctataactaaatagataagcctctttctatatgtaatacgattattattagttgtctttttgaaattgcccttataccaagttcatacggaacttggataattcatcattttaaacctaaataaaaagaaagaaatgcacaaagaaaaatgacaacttagttagccgaggtacgttggtacaaaaagaatcatgtaccctctttatcaatcaaaattacaatctaataattaatcgtatttatgaaaaaatgcaatctgcggtggtttaacccgcaaaaagtcaaaaaacaactggcgtttgttttggcaatctgtctggtttgtatggtgcctgtcactacctatgcccaaattcttaaaatatccatgaagaggactaatgtctctattcaaaatgtgatacgggaattagagcaaaaaagtgggtatactttcttttacaatgacaatcaggtaaaactcagtaagaaagtttctgtagatgttacggatgcacctattgagaaagtattggatcagatttttaataactccggttatacttataaaatagtagataatcagattgttgtttcggcagcaaagatagaaacttctaaaacatcctctctccaacaacagaaaagtgtacgtatcacgggacaagtgaaagatactgccggagaaccgattattggtgcttctgttgtagaaaaaggatcggcaagtaatggtacaattactgatatggaaggaggtttcaagttaacagtatcaggtaatgaattgcaaataacctatattggttatatgccacagaccgtaaaaattcatccgggagtaaccaactatagtatcacaatgaaggaagataccaagactctggacgaagtggtagtggtaggttatggtacacaaaagaaagtaaacttaaccggttcggtagcttcggttagtactgatgaaatcaaagaccgcgtacagacgaacgtgttgtcggctgtgcaaggtacagtacctggagtaaccgttatttcacgtcccggacaaacaccaagtattaacttccgtggacgtggtaacttaggaacttcgtcacctctctacgtaatcgatggtgcaattgcggatgccacattcttttctaaccttgatccaaatagtatcgaatctatttctttcctgaaagatgctgcttcatcggccatttacggttcacgtgcggcctatggtgtagtattggtaactaccaaacagggaaaaaatgataaaatgaacgtttcgtacagtggttacgtaggtttgagtaaccctacttacaaaccggagtacgtcaattctacccaatatgcagagttgtacaatgaggctctctacaattccaatccaaaaggtggaaaataccaagggtataccgaggaagaaattggctatttcagagatggttctaaaccagacttatatccaaacacagattggaatgatctgatattagacaaaaatgtactgaccactcagcattccttggatttcagtggtggaacagataagatacgttactttatcggtttgggctatgtgtataaagacaacatgatccccggacaagatagccaacgttacaacttgaataccaatctgagttcagatatcaccaagtggctgactgtaaaggcaggagtaaaatatatccgcaatgattccgaccgtgattgtggcgcaccttcattggccagtttctcaatggtaccggttacattcgttgcaaaacagtcaaatggtgattggggaactgtgaacggaggtcaatcggcaacaagtagcttcatcacaaacaatccactccgtgcattgagcaaatcggattggagtaaatcaaaaagtgaaaataccatgtacgatctcggttttgatatcaaaccggtaaaagggcttattattagcggacaaggtgtattcaaaggatatgaatataagagcaaaagttacaccgccttacaacctaatgccataaactacttttccggagaagaaatagttggaaccggagtaaccaaaaataaaatgagtatggactggcagagtacaaatacaatgctttatacggcgacagccagatatgactggtcgaatgataaacattcagtaggagcattggtaggtacatcttacgagcattataaatatgaaagactggcaggatcacgtgaagagttcccatctgacgcattaacagatatggaagccggctctacttcgggagcaggctataccaatggtgcaggttcatcggaatataagatgttgtcttattttgctcgtgttaactatactttgatggatcggtatttattggaagtaaacatgcgtgcagatgcatcttcacgtttccacaaagatcaccgttggggatattttccttcattctcggccggatggagaatgaatgaagaaggcttcatgaaagacatcgagtggatcaataatctgaaaatcagagcttcttatggtactcttggtaatataaacaatgtaggaaattatgattattttcagaattacagtagtggaaaccattataatttcagtgattcgcccgtaatcggtatcggtgaatccaaacctgctaatgaaacgctcggttgggaaaaagttgctttaactgatattggtttggacttcgacattttcaatggacttctgggtgtaacagctgattactatatcaaaaacacaagtgatattttgttgggatataacgtacctacagaaaccggtatcacagctgcaccttcacaaaacattggtaaagtgaaaaacacaggtttcgaattagctttgaatcaccgtaacaagattggagctgttaactacagcatcggagctaacattgctaccaataaaaataaaattaccaacttaggcggttcggacaatattattcagaccagcagttatatcgtgaagtatatcctgaaaaaaggggaatcaatcggttctttctatggatttaaaacagacggactgtatactcaagctgatattgatgccgggcattactacacattaagtggagtagtacctaatgcaggtgatgttaaatttgttcctcaacgtgacatcgagtacaaacaggagatcacagacgaagatcgtactattcttggtaaagatgtgcccgactttacatatggtgtaaacttaagcctacaatataaaggttttgaattcagtatgtttggacaaggaatcagtggaactaaggtagcatttgacgtatatggtgttcacccattctaccatggtcaggataacccaagaaaataccatctgaagagatggacagaagagaatccaaatccatatgctgcttatcctcgtctctactcggcaagtagtgtacacacaacttataatcgtaatttcagtgattatcatttgtttgactcggactatttccgtttcaagactttgtcattgggatatacggtaccatctgccacagtgaagagctggggattgcagtcattgaaggtatatgtaacaggagaaaacctgttcacagtacgtgctgataaaaagatggaagactttgatccggaaacagccggtggtgtgatttatacgctgggaaccaaatcggtagcatttggtgtaaacatatcattctaaaatcattcattaaaaaatagaattcacaatgaaaaacaatataagaaaaattgcattgggattatgtctcacaggagcgttaacagcctgcgatttagatgtggttccacctgctgacattgcagcagaaaacttttggcaaacggaaaaagatgcatggtatgctttaaatacctgctattctacattggatggtgtagacatttgggatgaattgtgtacagataatgcacatagccacaaaccttgggaaggaaacttcgaaatggtacaacaaaacggtataagtacagccaatggatatggaagctactattttggtaccgttcgtgtagtgaataactttattgctaatgtagataaatgtgcagtcagtgatgaactaaaaacacgcatgaaggcagaagcacgttttttccgcgctttaagttatcttgatttgaccacgaaattcggaaaagttccggtaattacggacgttttagcttatgacgcaccgaatgttaaacgtgacgaagtggaaactgtccggaagttcattcttgacgaattggcagaaatagcggaaatccttcctgatagttataacggtagctacatgtatgaaacaggacgtatcactcgtgccggtgctctggcccttcgtgcacgtgccgccttgtattttggaaattacgccgaagcagagtcatctgccggaaaaatcatttctgaaggacatcattctctgttccgtgtgtcgtcactcaccacagcgcaacaaaaagaagccaacgaaatggatgcttatattgattatgcagccaaaggtatcgataaagataaattcgtgaaaggtatgttcagttatgaatcattgtggcacaaaggtaacgcatctcccgccaatccggagtatattgtaacacgtgagtacatggctgatgcaaacaactatgattggacaagatatacatatttcatacccaaatcattctctcaatacgacggatactgttcttatgaaccgatgcaggacttaattgacgcatactgggatgtggatggtaaaacaatgcgtaatgacatcactatggaacagcgtaaagaacgttatgccgaaatatggaaagactttaaagatatgagccaatctcaattcattgaaaaagttccgcaaacggatattatgaaatacgactatatgaaagaattccgcaatcgtgacagtcgtttatatgtatctatgatgttccctttcaaaggatggcatgaaactgttaaaggcacattctatttccgttgggatccggatctgataaataaagatggtaatgaatcatggacgggatatttttatcgtaaaatggtcactctcgatccttatgatacttggactgctgaagaagattatccggtgattcgctatgctgaagtattgctgacatacgcagaagcacgtatccagaactccggatgggatacagaagtacagaaagcattgaatgacctgcgcgatcgttgtggtatgccggatgtaccgacttccatgccttctaaagaagaagctctggcttttgtacgtaatgaacggcgtattgaattagcggcagaaggccatcgttttgatgatatacgccgctatggaaacgactattgcagcaaggctatgaatggtccttcttatgctccaaacggatatgttgtaatcaacaaagtttgggatgagcgtttgatgcttatgcctatacctcaaggtgcaattgacttgaatccattgttgaaaaacgatcagaatccgggatattaatttaacacacattatttattgagggttaaagcccgttcatggtaatacatgagcgggcttttttatgtcccaattgatattcagaactgcaatttcctcatttataaccattcaggtaataactggttttacatctcttctgcaagtttgtgtaagttagatagatagaacggctcttgtgtttcaaaagacgttcgttttttgaaacacggtctttgctctgtgcgctgaatacaaaaagaagagataaatgactgataattaaaacgatgtaaaaagatttgcacagatgaaaaaagcgacttatctttgttgcatcagacgaacgtcttttgaaacgttaccttccttttgataaaagacaacccacttattacaagaatcatttttttccaaatgcttcattattagctttatcctttcgttacatcagtgggtaaccggattgatagtctggcagtatttttgccggatgttaccattcttatattatttgtttcctgcgttatatcgcttctgtactattctggctaaccttgcatcaacaatcacacatcgtataactactataaatttaaaatcaaaatgaacagagagaacaaacctttattcctatatacctttatcaccgtctttggtggattgattgtgggattaaatatggcaggtatttccggagccgttccttttttacaggaacaattcatgttggatgatatggctttgggattggtggtaagtattctgaccgtaggttgcctttgcggtgctttgctgggaggaggtttcagtgaccgttatggcaggcagaaagtaatgttctcgtcagctatcttttttattgtttcttctttaggttgcgcattgtctgtcaatctggtttcactgctggtttttcgcctgatatgtgggctggggatcggcgtgatttctgccgtagcacctatctatatatccgagatttctcctgcccggttgaggggaacactggtctcttacaatcaactggccattgtgataggaattctgattgcttatattgtagattatatattgctggactacgagcggaactggcgcctgatgctgggattcccgtttttctttagtgtagcctacctgctactattggttatattgcccgagagtccgcgatggctttcggcccgcggaaaagcaggcagagccagacaggtggccagtaagctgaacctggaagccggtgagatgaccgtgtccgacacaaacacacaagaaggtagagataggataaaggtaacagaattgtttaagggtaacttggctaaagtggttttcataggttctatactggccgccttacagcaaattacgggtattaacgtcattattaattacgctccttctatttttgagatgacaggtgttgccggggatattgcccttgtgcaatccatcctggtgggcgtggtgaatctgttgtttaccctgattgctgtatggctggtcgataaagtgggacgcaaaatcctgcttctcgccggaagcttgggaatgagtctttcgttgctttatttggtctataccttcgttgtacctgctgccaatggcatcggcgcattgatagccgtgctgtgttacatcgggttctttgcagcttcgctggcaccgctgatgtgggtggtaacttccgaaatctatccttcccgtatccgtggaacggccatgtcactctctaccggagtaagttggttatgtacgttcctcaccgttcagttttttccttggatactgaataacctgggcggatcggtcgcattcggaatctttgctgttttcagcattgctgcattcgcattcattttattttgtgtgcccgagactaaaggaaagtcgctggaggcaatagaaaaagaattgggagtggataaagaagctgaaaagaccgcaaaagaagaacatgctttctcgaaaatataataaacacaaaattagatataagtatgaaacaaagtaaaagaaatgtatggttgtccgtttgcgcaggactcttgttttgttcgtggggatgcggctctcaagtgtcggataagccggtaacactggaaacgctgttggacgaaatggtatcggtggaggagcaggcgctatatccggttccctcttatacttgtcgtcaggaaagtagttatgaccgtgcatcggtatcacccgattctgccggttggtttgccaacagcgatgggtttggaatcaagcgggtagatacgatagcaggccgtatcgagaaagtaatgttcgacgaagtcggaccgggggctatcacccgtatctggattactaccatcgacaaacgcggtacatggaggttttatttcgatggttccgatcagccgggctggatcattcctgcttacgacctaatgcggatcaatgtgcccggactgggaagaggaatgttgcaggcacacaccagctatacgcccgaaggtaagggaggaaataccctgttcctgcctatcccgtatgcccgtggatgtaaagtgacgttcgaagacgaaccgggagtgaatcctactccaaaatattaccacatcaacttccgtaaatatccggagggtacacaggtggagactttctctaaagaagtggtagagagagcagcacagaaaatagctgaagtagacgatcgtcttctccatccgacggccggacgtaaaggtgaaatgatccgggagaataagaaccttctttcttccgattcactgaccattccgctgccgacaggtgaaaatgcggtgtatgaagtgaagttcaatatccgtgttgataatccggatcaatatgcgcaattgatgcgggaattggtgttcagtgccacattcgacgggaaacagaccgtatgggtgcccttgagtgatttctccggaggtggcatgggtgctcccaaagtggatagttggtatctgacgtccgacgggaaagggaacatctccagtcgctggttgatgccttaccgcaaagcgggagtcttgaaagtactgaacctttcttcccagccggttgatgctgaactggaggtaaacgtggctccgttgaagtggaataaagaccggtcattgtatttctatgcttcatggaggcaggagaacggtatctacatccatgataaacccgaagaggccgatcagtgtgtagaatggaacttcgctacactgaaaggaaagggggtctataaaggtgatttactttcactgtacaatcatgctccgttgtggtatggcgaaggtgacgagaaaatttgggtagacgatgatactttcccttcacacttcggcaccggtacggaagactactataatagctcatgggcaccggtagtgcctttctatactccattcggaggagctccgagagccgatttggaaagctctcacggttataatgctttctatcgcacccgccatctggatggcatccctttcaataagagctttaagttcgatattgaaatgctgggatggaaacggggtgaggctgattatgccactaccatttactggtatggtgatccggaggcacaggtatttggaacttcaggtattgaagaagctcgccggcagttgctgcctgctgtcgaagcttcggcaaactgaaaaacatatgatagtattatttaaatttttaattaaatctaattggtgaatatgaaacatgaaagaccttgccttgtggcctccggaagtgactggctgcaagaagtgttgagaaggcttttggtctgggtggttgtcttgttctcggggacaatgatggcatacgcaggcaatctggatatcagccaggtgaaagtcattacgggtacggtgaccgaaaaggaaacaggtgacccgctgatcggagtaaacgtgtcggtaaagggcacttcgaaaggtacgattacgaatctgaatggtgagtattcggttgatgtgaattcggataaagatattctggtattctcatttattggaaaggctacacaggagaaagctgtgaaggggttaagcaagatcgacgtggtaatggccgatgatgccacgatgttgggcgaggtggttatccagaccggatatatgacgcagcgcaaagccgatctgaccggttcggttgccattgctaatacctcggatttggctcagaatccttcgactaacgcactgaagtctttgcagggaaaattgccgggtgtatttattactgccgatggtagccccggtggaaatgcttcgatacagattcgcggacttacgtcattgaatgcacaacccaacccgctgatcgtactcgacggattggcaggcgattacaacttgagggacatcaacccggcgaacattgaatctattcaggtgttgaaggatgctgcttcggccagtatttatggttcgagagctgccggtggtgtgatcattatcgaaacaaagaagggtaaaaagggtgaatcgaaaatcagctacgaaggtcgtgtacagttttccaagtgggttaataaacccgacttgctgaatactgaagaatatggacgtgccatctggcaggcgtatgccaacgatgacaaattgggtgagatcaaacaaagtgttcgtttcttcgattacgactggagttatgacggtaacggttatccggtgcttaactccgtgaaaccggtggaatggctgaatacagccaagactatgcgctcggccgatactaactggatcgacgaaatatcccgtaccggagtatcgcagaatcatcagatctcagtatcgagtggtactgaaaaatcacgtactttcttcaacctgggttatgaaaatacggaaggtatccagattgaaaccttctggaagaaatattcggcccgcttgaactcggaatacgatttattgaatggtcgtttgaaagtaggtgagaatctggagttgaactacatgaactatcgcgaagccaatcatactcagcttgcagcgaatgaaccccctatcattcctgtatataccgaaaccggtggctggggtggtgcctctctcgacgtgggtatggacgattatcgtaatccggtgaaagaccttatcctggggaaagacaatgtcaataagttcctgaaggtaattggtaatacgtacgccgatttgatgattatcaaaggtttgaacctgagaacatcgttcggtgtagactatcgcggttcatactatcgggcagtcgataaaaaatggggtgaagcagatggttcgggccgtgatgaaaaatttaattatgtccgcaatgatcagacccatttccttgaataccaatggaccaaccagatcaactataacgggcaattcggaaaacactcgataggagctgtagtcggaatggaattcacgaaagctgaaagcgaagcattctatgcacggaaagacggtttgaccctggaagacagagactatgcttttttgagttcggctaccggcgacaagattacagaggctaccggttcgggtgatgcttatgctctgttgtcatacttcggtaagtttaactattcgtatgcttccaaatatctggcatcggcaacgttacgttatgacggttcttccaagttcggtgctgataaccgttgggcagttttcccagcattttcgctgggatggagaatcaagaacgaaccgttccttgagaatgtagattttctttcggatctgaaattgagattcagttgggggcgtaacggtaactcggctatcccgagtggatacttgcaaagcagctatgtagccgattataacggaacttcttatgctatgaacggacaggaaagcggttctttacagtctggtttccgcaaatatctcaccggtaattcgacactgaaatgggaaacggtgacacagaccaattacggtatcgatttcggtttcttcaatcagagcctggtcggaactatcgactatttttataagaaaacaaccgatatgctttatttacccccttatatcggtgcgtttggtgaaggtggagatacttatgtgaatggtccgagcatggaaaaccgaggagttgaaatcttgttgacataccggaataaccttccgtccggatttagttacagcattacgggaaaccttgctaccttcaagaataagattaccgaattgccggacaacgtgagaagtgtatatggtggaaacggtatgttggacgatattatcggacgtcctcgtaactctgtctacggatatgtggcagacggaatcttcaaaactcaggaagaggtggacaactcaccgcaacaggctggaaaaggcttgggacgtatccgttacaaggaccttgatggcgacggacgcattactcaggattatgaccgtacgtggattggtgtcagcgatccggactttacttatggtttgaaccttcaggcttcatataagaatgtagacttggctctcttcttccagggtgtacatggcggagatgtttgggattcatggattgaatacagtgacttctggaacattcagaatgtgaataataccaatcacctgaaaggcgtatttaatgcctggtctccccagaatccggattctaacattccggctctgtctacccgtaacaccaatgatgaaaagcgtacatctacgtatttcctcaaagatggttcgtacctgaaactgagaacagtggaattgggatacactttcccggaaagtctggtgaagaaagccatgatcagccgcttgcgtgcctatgtttcggctaacaatgtattcactatcaagaaatggtgggatagcaaccgcttctcgggtcccgatcctgaaatccgtgactttggctatgtcattccatttaccgctacagttggagttaatataaccttttaaatagaaatagtatgaaaaccttttatagtttatttctgtcatctgcccttttgctttccttgttggtgacgagctgtgccgaccaattgaatattaaccctaaaggggtgctggctgatgatttattattaggaaagcctgaacatattgatgattttgtgactccgtgctattcgctgatcccttatctgccctggtcggaagctcatgcatggtggatgcatggttccatccggtcagacgatgcttacaaaggcggatcgggtgtaagtgaccagtctgcctggcacgatatggaagttttctcttctgtgaccgctaatgtaggcaataatgacggaccttggttcaagggatatgtagccatatccagatacaatctggcactctatgccctgtctaaagttaccgatgaaaactatccgttgaagggcgtacgtaccggtgaagtgaaattcctgcgcggagctacctatttttttatgaagacgctgtggagatatattccttgggtagatgaagagaatggcagaacggtggaagatgtgaccaatatctcgaaccggcccaatggtactgatgatacatatttgtgggaacacattgtagccgatctggaagaagctgtcagactgttgcctgaaaagcaggaagagataggccgtatcaataagaatgctgcacgggctatggctgccaaagcgttgttgttcatggcatacaagcaagatgaaagacatcaggtagtcgaggtggataagaagattctggaacgtgccttggtttatatcaacgagatcaccgatcaggaaggtggaaatgtaggtttatgtgaagactttgccgaaaatttcttgccggaatatgataatgctaccaaagaagcaatttgggaaatccagtattctatcaatgacggaacatcaagtggaggaaatacaaacaacggtgcagaattgaatgctccttcctgggaaccttatttcccatgttgtgacttccataagatgagctttaatatggcaaatgctttcagaactgataaagacggtttgcctttgttcgatacgtttaatgatgcggaactgaaaggaagattcaaagagtatttcagtgaaaatactttcgatcctcgtctgagtcatacagcagccattccgggatatccttataaatataatccggacttgttgtatgaagagaaggcttccagaagccccggtgattatggttatctgaaatctgttaaggaattggtacctgccggttgcgattgtatcattgtaaaccgcaactcaatgaacgtgaaacaaatacgttatgctgaagttttattgtggaaagctgaaattctgattcagttggatcgccataaagaagctcgtcctatcatcaataagctacgcgaacgtgccaataacagtagaatccgtctattgatggcagacggtactccttatatgaattataaagttagtttatatactgacgaggctgcatggaccaaagagtatgcatggaaagcactgatgtttgagaatcgtcttgaaatggcatgtgagggaagacgtttcttcgatctgcaaagatggggaattctggaacctacgatgaatgcttatttcaagaaagaaaaaactcgcttctcgtggatgaataatgctgtctttgttgcaggaagagatgaatataagcctattcctcagcaacagatgaactgggcgaaaggaaattatatacagaatccgggttactaataaaaaacagacgattatgaaaagaatactatattttttctctgtgatgctttgtatacttgctgtcacaggttgtcaggatcgcgatatcattgatttcaaggatggggtttctttgcccccggtgaccgatttgaaatcgtcactatcacctgataatgaagctttgattgaatggaaattgcctacagcgattccggaagaggtggaacgtcctttatccgtttatgttcaggtttacaagggggcggtgttagagcatcagatttctttggaaggtgagcctacttcgtgggaatatacactgaaagaacctgaatcgaaatacaggattgtggttaaagttcaggggatgttgaaagaaaagccttatgggcagtcagacgagatttattcgttgggacaaacagtttctataaattgattgagagaaagaggcagcgtcgggacgacgttgcctctcttcattttatgctttctcacatcggatgatgatttttctttcatcgttcagggtagtagcaaacagatagatatcacctccgtcagctatttttagccgttttcgtagttctgccacagattgtgggaagttgcggacagtgaggttggctttatccacttcatttaagagattcttcagttcttttttgttgaggcatgagtagccggtcacccggaagattcggcctggaaattcttctatccgttcatccgaggtgtagagatggctgttgggatggagcttgcttaaatgaaacgcagaagcgatgctgcggaaagcaccggctttgagaatagaggcgttgggttcatacaagtaagtacctattttatgggtgtaagagcaatcggtgctctgctctgcttcgcgcgtaaagacgaaacgctgtatttttcggtttgcaaagttgatgcatacgataggctgcgatagggtaggcaggatcatcggagatgtcttttcagaccgcaacattaacaacagttccttacattcgttgttgacggagataatgtggacctcagaaacatgcttcatgtcccgtatagccagagaaaggtcgagcattggggaaagtttgattataacctgttgccctttttcgagcaataattcctccagtgcggctgcattaggttcacagtcggatatggctactgtttttccgccatgttcattgcggcgtgccgggtccaggaagatacagtctgtgggcgacattgtttgcaagtactctactccgtcggcattttgtatccggatctgctttaatcccaataatggaaaattgtgagcggcaatctcgcaaagttctttttggcgttcgatgtaggtgactgttttaaaccgggctgcgagaaaagcacaatcaataccgaatccgcccgtaagatcgaccagcgtttctccctgtgccagtgaggctttgtagagtgcggtgatttccgatgaacattgttccaatgataaatgacgtggataaagaagattttccgtagcatgccaacttggtatttttgaagcggcggcttgccatccggctatctggacgatagcagaggacatgtcaacctggggatatttctttgcctgtaatgcgagggagcgtatatcgtcattgcgatgctcccggataaacaggactgtttccggagaaaggtacatatcttattttagtttataagtttatacttttgttttgcttcgtctcggctgcacaggttaaagtgccaccattcgctggggagtgcacggaatcctgcacctttcatgactcttcttagtagaattcggttttcgcgttcttgttgcgttatttttccctttttcacgagttctgcttcgtttgtgatatgcgatgttgcacccatataatcaacttcggttcccatagaaagtgggtgcccgagagagtctactatgccgatgtctactgccaggccataattatgcagtcctcctcctcgtgccggattagatacatagaaatatttagaggttccttttacaacatcccacatctttttctgaacggacatcggacgtgctgcatcataaatcaccaggcgatagccaggatgctctgctttgagtaacaggtgtgcctgcaaaagggctttagctgcgtccggatggagatatgcctctttcaaatcaccataaagaagttgaccggtgaaattatccggggtggcatacatcaggttgattatgaatgtagagtcgagttcggagatatttaccagtccgattgagtccagataaagagctgtttgacttttggctgcaatcggttgtggcttttctggggctacaagatttatggagtccataggtacgggatagaactgcgtttccttattccggcaagaggttgtgataaacagtaataggatgaaagttgctaaagatccgggctgcatatgatttttttagttgaattattaaatgcaaaagtataaaaacatatgcgcatattttagaagtgaggaagtttttcgtttttaaggcttgtcctatatgtacctcatcggatttacaatgcattataaattagattttcccgatagcttttttgagtaaaaagcattagtcttttcatcgtgcctgtctttcctgccatacttgttttcctctgatatttgttttgagaggatcatttgctttcggtttattgttgtaatcgttaatttacttaaaatgaagaagatcaggagtaggctaatgaatgtgaagctattccttttcgtacatttggcagaaaggagtaaaagctgtattgctacgaatgtaaactataggatttagaatgatatggaacatgttaatggtcaaaataatgaaattacattgattttcccacataatcggattgactgtatggcttctcagaacgaacggtttaatcggattataaatcaagctaacataacgatcattgggaataacaatcacatttcaatgtattgcgattctgaagatagtgcggaagaattgttgctaagtgatggatttcttctggttgtaaaaggagataataatatagtaaatatagggacgattattttacgctattctaccatattgggtatgacgggattgaagcttatcattgggcaacttccggggctgggagccggtgtttcaagaatggctaataattgtcgggtagatattggaaatcgtgtagtaattaatggcgttacgttatatttgcaagaagatgattcgtgcatcagtattggagacgatagtcagttgagctggggcgttgatatatggtgtaccgacgcacatacgataacgaatttagagggtgagccgataaattttgctaagagtatcgtaataggtaagcatgtatggatcggaaaagatgtgaaggtttgtaaaaatgtgaaagtctctgataatagtattattggttgggggagtatcgtaacgagggtatttaatgaacccaatgtaattattgcgggtgttccggctaaagttgtaaaacagggaattaactgggaccgtagatgtatcaataagtatttaaaaggatgactactgttagttgcaaaagaaaagtgagggtatgggtagaggtaattgtaaataggggcgctgctctctatggagagtcctctctatttacacaaaatcgtggacagtgccttttctgtcctctcctccgcgaaatgcatttctatcttccatcttccacctttttccatctttttatctgattatcatttatttaccctggtggaagattgcgttttcagcccgtttatcttccaccttcatcttccatcttccaccctctgccatcgcttgaaaatctttcttaattccctcgtattcagaagtatactttctgtttcttgtcagtttttcccttaaaaagcattttcatatccccgcttgtttgcttgaaaatgttctgcttttttccggaagtcctttgttatttgccgcttgggatattctttgcccccgtccgccccattccctgtccgctattccctttctcccgccttcctgaatagacggtgtctgtcctttaccttgtcctcccgctttcctttcaccggcgctttccctcaagcatggtctgtccgaagaatgcgttgccttgacgctgcctttacgcgcgtacccccgtaaccttgaatgcgggttccatttaccaaccggggtaaacgcttttaccaaccggggtaaacgcttttacatgccgaggtaaatggctttacatgccgaggtaaatgcttttacatgcctgggtaaatggttttacatcaagaataaaattcaggtaaatatactcttctgattatcaatgatatttaactgctgacccagctacacatttatcctggtgcctcctgagaatccctttcccatatccccccggagaaatttgaaaccgcctggcggttcgttcccaacacagagattcccctccctccccaatgaatcccccctccttgttttccaagtattccccctctatatattataataatgtgtctccattggccctcccttttcccttctttttaaagtatgctctaaaacctgcctctccctcagtcctttacatctaaatttatatttttattcaaaaaaacttccttatatatttgccttgtattggtaaatcgcgtacttttgcaccatgaataaacgatattatgaacatacgttacccattatacgagggagtttatcgaatacttacttttactttggctacaaaagtaacatcacatttttagaatgaaagggggagtttatcgaatacttacgaaaatataccggatgaccacttatgaccgctgcccgagcctgcttcaggagagtctgctgctgtccacctacgagtatatattcgcctcgccgcatgagaggaaattcggaaacctgtgccccgacgagatctgcgggatgctcctccggaacggtgtcccgcaggaaagcctctgctaccagaactacgagagcatcctcgccggaagggagacggttctttacgagttcacctccgacgggaaagccaccctgtatctcaagccgatggaccatgtgagactggagatgacctccaaagggtatgacatggtccctatggggattcctcccgcccggacactcccttcccccgcggaaagcatgaggaatatgccgcagctttccgagaagatcaggaaaacaaagaaagcccggagcggagagaaacccgccaaaggagccgggaagtcgaagaaacgtccccaaataggataatccataaacaacagataataacctgacaataaaaatgtaagaaaatgaaagtcgtgatttgtgaaaagcccctcgtggctaaaagactggcccgcatattgggcgcggacaaaatggaagacgggtatctcatcggaaacggatacgccgtcacatgaacgttcggccacctgctggccccggtttccccattttcctgtatggaaggaccttttacaagggagatgcttccccttgcagtcccctccggactcgccgtccgccggacaaggacggaagacggtttccgggatgaccccgtggccgtcaggcagctggaggtcatccgcaggctgctgcaggaagcggacggggcggttacggccacggacacctcccgtgaggggcagatggtcgcccgcaacctttatgattatctgggcttcaaaggaaaaaccgaacgtctgtggctttcctcactgacggacaaggcgatccgcgaggcgttccttgaccttagaccggacagtctctatgaaggtctgtacctggcaggcagggcacggcgggaagccgaccggatcatcgggtacaatgcaagcctcgcgctcggcatggcagccggaaaaaagaaccactcgctcggacgggtacagacaccggtgctcgcgcttgtctcgcgccgttacctggagaacagggatttcaacgccgtaccttattaccggctggagctgtcggtcctcaaggacggtaaagagcttgttttcacctgcccggaaaaatacatgcagcagcaggaggccgtcgccgcccggaaccggatcgcggcatcgcgtgtggccacggtaatacaggcggagagaaaggaaacggtggaggaaccgccgcttttgcatgacctggcctccttgcagaaggaggcgaacctccggatggggctgacggcaggacagacggcatccgccctgcagaggctgtatgagggaggatacatctcatacccgcgtacctcctgccgctacatccggcaggacatgccggaggatatgccggcactgcttttccttctgaaagacgacccgtgtttcgcacgtcatgcggagacaccggaaggcagggtgctgtccgtccgtaccgccgatgacggcaaggtgaccggacaccatgccatcatcataacggaaaacatacccggcaaactgccgcttgatgagcagaacctctaccggatggtcgcaggcaggatgctggaagccttttcgggtgactgcaccaaagaagaggtggatgtccgtatcgaatgcgggggaatcctgttcgaggccggataccgccggacggtgcatgccggatggaaaaacgttcataacgagaccgggaaagaagaagacaccatattcccttcctgggggcaggacgaggtgctgccggtaacggacatatccgtccgaagcgtggaaacctgtcccgtaccgctttttacggaagcctcgctgctgtccgaaatggaacggtgcggactcggcacaccctccacaagggccggtgtcatcgaactgctcatcgcacgccggtatgtcgaaagacagggatgcggcctgctgcccaccccgaaagggctggaggtgtatgaggccgtcagggacaagctgatagccgatccggagatgaccgcccggtgggaaaaggacctgcaggagatcgagcggggagaactggacgcggacgtgttcatccaaaaggttggaaaatacgcgcggcagatcgtggaggaactctcggcggtccggttcgaacatcccggaccgccccgacaccgctgtcccaaatgcggcatggagacactgacccttcaccggaaggtggcccggtgcggtgacccggactgcgcgttcctgctttttaggacattcaacgcaagggagctgaccgacggagagatgctttgcctgctggaaggaaagaaaacggatttcctgccttttgtcagcaggaagggaaagccctatgaggcatcccttaaaatagacgagaactacaggatagagatgacattcagggacatcccgatagagagacagccgttacccgccggcgacccgtctgtaatgcaggcggcagacatccctgtcgaaactccgcatcccggccagctcccataaggaaaatccggggcatccttggaacaggcgggagccttccccctggaagcggggcaggacatacaagaccagctcgtcggccatgtcaaagcggagcaggctgtccgtaaaaggaagcgtctccaaagccgcttccgcaaggtatacaccggaatgcccctgtttccattccgtcagggacatgaaggatacatcagggccaaggcaggacaaggcagcctcccggatacgggtgatgccatatttctcggggtgttcccacaaatcgggaaatgtactcctgcgggcaaggtagccgtcaagggtaatgaaagccaggatctgaaccgtcgccatatgaataggatattttttatttcgtaatggttccggtagggtcatgaaaaaaacgtgaccctacgtggctccaaaacggaggttctggcaaaacctttgaatagttgccgcgtagaagccacgctatgacaatgcatagcatagccttacgcagaagcctctattccgattgaaattttgccagatttccgttttaagagcgttccgcgaacgttatgtctatatatcaacaggaccggatttaatccccgttcctgaatgaattcatatttccggggtaaagataggaaattaatccgatattccgggcaaacaggttcgattgattcattagccgcccccaaaaagaaggagggcgtgttttccgactccctgactattgccgacttttcatgactatggctgacgcgttccgtacacgcatggaaaattgcgttatcttgcacccgaaatcataaaaaaagattatggaactgacacttattgaaacgaacgcgtatctggagctaaaaagaaagctcagcacgctgtcggtacagatggccgacttccaaaagaaaatcgctccgtcctcaccggaaaagtgacttgacgcacaggaggtatgcctggccctcggcatctccaaaagaagcctgcagaaccatcgggacaggggactggtcccttattcgaacatcggaggaaaatgcttttacaaggaagcggatatccggcaaatattggaagaaggcctcattaaaaaaagaaggaaataatggcggaaatcattacaaaagattcggaggagttcaaggaactgaccggatggatgaaaaagatcggaaaatcggtggaggcggcgacggcaaggatacgtcccgccatcgcggacgaacattacctgcagggggaagacgtgtgcgaaatgctgcacatctcaaaaaggaccctgcagacgctgcgtgacgaaggagccataccctataccaccatcggagggaaaatactgtatccagagagtgccctgtacgagaccttgcggaaaaactaccggaactacaggcaatacgccggataaccggccgtaaagaaaaagaagaagggatgcttatccggcgagtccggtgaagcatcccttcttcttagttggccaggcggaacatcccgccgatcttctcacgcatcctgtccgtgtcctcaccgatttttggattgatcagctcggcgtaaacctgcgtggaaatgatggtcttgtgcccgaggactttctgcagggtttcaagcggcatgcccttgctcagggccagggtcgcaaaggtatgacgtccgacatgcgggctgacgcggacactgcagccggccttctcgccgatacgtttcagactgtcctccatactccctatttcccccacggggaacaccctgtccggagaaaccttgaattcgttcacccccctgtatttctcgatcagctcgacggctatcgggagcagcttgacaacatagggtgccttggtcttcacacggtttccaaccagccaggtgttcccgtccgaatccgtgtggacattccggtaagaaagttccttcaggtcggcatgggccaggccgctgaagcacatgaaaacaaacatgtcccggatggcctgctgccgcctgtagctcagcttgacgctgataacgcgttgcaggtcctcctccgagaggaaaggacgtttcttgtattccggcttgcacacgaacttcttgaacgggtgcttgtggatccatccctcgtccattgccagatacatcagccatttcagtgtgttgacgcgctcgaaggccgttgacttggccagcccgcgcacggaaagcatccagttgtaatagttcttgatgaaatccatgtccagcgacatcagggggatatcctccgtacccaacttgtccttcaggtaacaggacagacacttgtactcgtccaccaacccccggtaggtgctttgggctttcgtcttgccgatctgccgtttgtaatcccggatctggatattgaagatctccatcaacgaatggatctcctcgccaaagccgtatagcggtcatagacattcttgactgtcaggaacgaatcgtggtccgagagatattgatagtgcttgccgatctgtgccttgatgttctccagctcccggttcagccgtcttgcctcctcggatttgcctttggcacagttgcctttggcatcccaaagggcaaggggaacatcacgcttgcagctgaaactcgccgtcgttccgttgacggtaatacgccccatgacagggacacggccattttttatggcctggttcttggtgtagaacagaactcgaaaggtactcctcataactcgattatttttgttacaaaattactatttatcgagttgttttaagctatgaagaataatgcaaacaattgaaaaataaccgcttatattgtctgttttatagacttggacaaggtaacgattaggtaacgtaactcatgctcaaatgtgctttttgtagcgtcgtttttcaaatggaagtgaaatacaatcccattaattcgctgaattcaagcggtgtgtcgccattatgcaactatttctaaaaatctccgactttctttgataaaacagaggatttttagtatatctatcaaaatacagaattaaaagcaccaaagccttccttattgcattcaaaaaccgacacgactaatacaaaagcaaaccacctatccggaaattaaaaaataacttttgcccagcatatttaaatacatgccgaacaaaagtcattcatagcagactacatcacgcacaaaaacaatcaattcgcttccatttgcttatcaaacgcttgttgaatcaactccatgatatcatccaattcattcatattcgaaataccgacttctacatcgccattgccccatcgtcccaagttggatacatctttgcacaaaccttttggatcaagtatatctgcaaatgctacatttagagaaaggcgcaaccgggatttctgaggcacgacatccacaaaattagtataagccttaaaggcaatatacaacttcttgagttcctcctttacggaaggatctatattcatgatccttctgcgcaagacctgaaacagagtaagtatgtcccccttcagatattcatagtgctccaacgtatactctgcagaatctctctccgcagatctataaacttcgagtgtctccggcgataataacggaaatctccatatttctttagctttctcagccaattgccccgcgcgcacaagtatctgctcttcattccacgaactgattttcctcaaatatgaattgaggcgaataggagaatcgtcgaaacctccctccatactcttcttttcttggaacggacgatcactcaattccgaattataacctgtcagagtcagattaccaagtgtgtgtaaatatttaccctggacttctacccaaccttcccctaacatttcttgccactcgtgtgatagattaggattttggggcatgacatgctcgatggtataatcagaaatattcaccatctccttacgctgaaaattttccaaccgatttaaaaggtagttcctgttacggaaattataaacatctttggtttgtaggaaagtagtgaactccgtatcgttcggaaagcgcttataactatccagcaataggaatgcagctttcagaccgtccatataattcgctttatcgaatgacttatagagagtagcgaacgtcttattcaggctatttgtcggtataccgcaaatggcgcgtctgaacacataattctcaaccagacaaagagcttcgtagaactcatccctactgataacttcgttgacataatcgttgtacaacggtaataaaaacgggtaactaacgtcaaccctcaactggctgatgcgtttgaaagccccgcaaagctgcttatccggctctttgtgaagcaccatgttgacgtaatatccggaataagtataaatgtctttgactacttcgctgatcgtatcgggagctttaccccctatcacataggccttgaaagcatcatacaccatatcgatacgaggaatggtgcctgtcttcactgataagtaatcgcgcatgaagctattaaacagcgccgcatattcactaccatatccttgttccataggataccaataagattcataaagtgaggtctgcaagtgaacttcttgtcccatcagcacgtaattgcgaatcaagtcggcttgtgataaatcaagtcccgtactgttcatgctttcaaatatcaattgtgggttgtccttctccttttcaagagccacatccacaacaaacagtcgctgtaccccgctataaatagctaccacattctccttgtttatcttacttttaaagaagtcatagttttcaatgatgcgttgtgacatcccctcggactgaggaatccccttcaataaatttatataggtatctttatctctgcgggtcagcagaagtttataccgcaattcattatcttcttccgggttgatcagataatagttctgaagtttagtgaagctggtatctatctctactgcattctcttttataaaatcggcaatagccgctatcagcaaagagacggtggtcaagcgctgctgtccatcaataaccagaagtttaggcacatcggacactgtatgtatactctcctgaaaataaacgatagaaccgataaagtgcccctggacggcagaatcgttgctaatacgcaaaatatcattcaacaattgattgcattgaaccagttgccaactgtatgtacgctgataaatgggaatcacaaactgtcgtggtccctttatgatgcttaaaagattattggaagatgctttcatagattatgcttattttacgataacaaaagtattctttttcccgattataagagaataaaataggaaaattatcaatagcttcctgtttttgtccgttcattgaccaataatatttctcactacctttgattgaacataatagagacagagcttaatgattgtccacaatttaacaagggagttagtttccatgataaaactacaaaatttaaaaaggaacttaaaactctgattaaaacacgggacaagtgcacgaaggacttgagaatcttcttgttcgtagacgatattaatcgatactctgagaagaaaatcatccaatcgatcgattcttaactcagaatattctattaccgatatttaatagcaaagaatttactaatcaattagtataataagatacatcgagagaatatctggatcagcagcaaatatttacgtcacttaatcgaattgttagtactggtcagtaaaactaaggatgcatcttttgtcatcaggcaaaaagaggaaacacagggaaatacggttgaaacatattccatcactttactaaaagatatccatgtgaaccgaacaaactacgcgattctattgaatgtgcccgatacacggttatagcctattgagagccggccatagacttgagaaaatacatataactcgaaaaaaatacatttttttttgctcactcctgaacaaaattgatttcttctgcgtttataattatgcaaatcggcctgaagcgctttatgcctatgggaatatccataatagtcgcaccgtatgcctccccggcatagacaggtaagattgcatagtagttttgtcgtgttttattttgtgtttgtgttgtgacggtgctgcgatgtgaatcgaagtaccgttttttttgtacctacctctcagaagctaaaagatttaccataaaagaagcagaatacagagtaacgggttaaatgttccgatggacgaattgtccgtcgatccagaacgtggcatgctcagaacggaacttcagtaaaacgtattccggatcagtcggtccctttggaaaatgggcgataaaccagtcttgccaatacttctgtttgagtccggcatccgtcactacctccacttcacccgtcagggcaacgctattcccttgttcgtagaaacaaagacccgctttcgggttgctccggaaatctttcgttttcacagaatgttctccggttgccatccaaatctcagaaataccttccgaagcaatcttgctcaaagggacagggcggggatatccctcttgattgaccgaactgagtattaccgtttcacaaccttgcagcaaatctactgctctttcgtttaatgatttcattgtatatgatatttagattgataatccctgcaaatataagcttgcccacctaccccggcgttgtaaaaaaacgacttttgcagaataagaagcagactaaatttcttacagacatagtttattttacgctcgcgatacaatgcctgtacccgaaaccaaatccgaaacgcttttctaaaggagatttcctttatcacccaaccggtattttatttctcaatatacgtcagcagcccctcttgcggtaaggtcggagaaagaaatgattctgccgtaccgccggacagtgtcttaacctctttcaggaagtgcgaaacatcgtaatatccggcattcaccgctaccgagagcaggttatttgcctccgtcgtacttttcagcagatcgatcgcctgcctgaacttcacaatccgactgtattctttaggggtaaatccggtaaacagcttgaaccgccgttccagatgccgttgacacaaacaagcatcttctgccagcaaacggatctcccgctgaccgtggtacaaatgaatgtggtttaccgcaaaaacaatctgtttgtccactacatcgtgcttgtacatcgaccgcaccaatactgtctcaatacactgaatcctgctccgcaaatccggaagctcgtagagtcgctctgtaaacgaatcatcgaacagcttgattcccaagtcggcactgccgatccgctgaccggccaactcctgcacgggcaagtccatgaatcggaataatccgcaaggatgaaaacgaataccaaccatgtgaaccgtttcggtatacgcaaccaactccgaataacgtttcatcggtcccacgaaaaacgaacggcaagacggcatgatccgtccttcgttgcctaccggttgtgttatcccgcccaaagcgaaaatcaaatcggtacacccgtccggcaggacgttgatacgcatcccatactcaggacttcctttgaactcccagattttatcgacgtaaggagccagcagtccacaaggttgatattctctatacatacttcaatttcgggcaaatatagtgagaatcactcacacctgctatttatccgaatacaaaccgatatggtttccttcgctatcggcaaaaacagcgaaatgtcccctgccttcagcgtcgatcttcgtctcggggataatgactttcccgcctttctgcaagacacattccagcgacttgccgatctcttcgcaatagaagtgaatcaatgttccccgctccgaaggcaggaaatcgggtgcccacgacaccgctcccaccgcttcgccctgctccatgaagcaggccatcttctcctcttcatactccgagaccgccaatttgatgtccaacactgtttcataaaatcctaccgcccggtggaaatctgccgccggaatctcaaaaaacgcaataaacttttccatgttctttctattaataaggtgaatactgtatgccggaagtcacgtctcccaagcacaccgcaaaagtagggcaaagcacccgccccggatagtaaaaaacagacatcattcctccacagagaaataatcggaataaggagcgcaaacagctaagtattccgccggagtatatcccgagaagagtttgaactccttaatcatgtgcgattggtcgaaaaagccacattcgtaggccagttgcgcaaacgaaatgcccggctggcattgcagggtgtacaacgcccgctgcatccgcacaatgcgcagaaactccttgggagtagcgcctacatactccgcaaacacccgcccaaactgcttattgctcaggcaggctacgtccgccagttgtgccgtacggatgtacggatggagggttaccgcctccaaagcggtcgaaacccgcttcaggttgtattcggaaaaagcgtagagacggcttaacagaaacttttctatcaggcggatgcacgccgcctgatccggcatatcggctacccgcctgctcagatcaaccagctgaggatcgtccgtctcttcggtatttacattcatcccacgaaactcgctaacaggcatgtgaaggaaagcttttgcggcaaagggctgaaaaacgactacgatcatctccagcatccctgtagactcaacatcggaatagccgaacgcctgcccgctgatgaaagaagagggttgcaaccggccttcggtcagcgaaagcagttgccgcccccggtgaaagaccatctggacgcaccccacgggcagcgtccgttcggataccggcgcaagcgcatcgtcgctcaatacccagtaatgccggacataagggacaagtgccgcagcaggttttatgattctgaatgattgcatagactacaaatatattgttttttagatcatcacggcaaagataaggtacgggaaaaagaagggataggaaaaaagagacaaagaaaagcaagaatggacaaacgcagctgatatttagaacgtacttttgtccaccaaaacaaacaggcatgaatatacaagaaagaagcaggatagaatatcattccaggattaatagggtgatggatttcatcgaccggaacctggagcaaccgatcgaactgaaagacatcgctgccgttgccaacttttcaccctttcatttccaccggatatttacctttctgataggtgaaacaccgaccgagagtctgtgcaaaaaccttagacgctatattgaattatcatttatttttcgttgaaagctcaaaaaaaaagtcggcagaaagaaaaggccatcccggaaaggggtttaaaaaaaggtctttaaatctagctgaagcataagtttaattttaatagataaaagactatggcacatcagagtaaatatcctagtttagacagacaatggcataagatgatgttttctttctttgagtatcttcctatgcaatatcggcaggcaacggaaagagaatggcaaattcgtaagatgatatggagttttaaggatggaaaagcttatttgaatatagcttggatgatagcgaataagttacatcaagtttttggtgatgatgttaagaatattgtttttgcttgtgttccggcttcttccgctgataagaatgaacttcgttataaggggtttgcttcggctgtgtgtaagttttcaggtgctatcaatgcgtatgaacatatacgtgtcagtggagatcgtttggctattcacgagaaatttgacagcaagtcgcttcaaaaagtacaagtgatagaatttgacaaggacttttttcggggtaagaaaatcttggtatttgacgatattttaacaaaagggttttcgtatgctcgtttcgcatgtcagttggaaaaaataggaggtgaggttttgggaggtttctttttaggtaaaacagttgtccgtatgttataagatgaaagaaaaagagagttatatagagaagcagaaggatatctttggagatactacttggttcacttatcgttatgaggtgaatggaatggtgtatgaaacttcggcaggttcgttggatatatgtagaaaggcacgtgataaatggatgaaaatgatgtccgttgcttttaccggtcatagaacgatacgaacaaataaatatgctttgtccgtatcgttgaatgaagaggtacgtttctgctatgagaatggaatccgttttttctatattggttgtgcggttggatttgacatgatggctgctcataccgtacttgaacaaaggaaacaatatcccgatatggttttggtggcggttgttccttatgtcgggcaagatgtgtatttcaacaaagaggacaaacagaggtatgctgatattttgcgccaagccgacaaggtggtagttctatccgaatattattatgcccaatgctatgcccaccgtaatgattacatgatttcacacgcctgtaggctgattgcctattgggatggaaaatctgccggaggaacttcttatacgtttaacaaggcacaaaaaaagaaattggtgatatacaatctgttttgattcagattgtatatcgttgttttccagcggtatgatcaaacgtggcgatgtcatactgtctggttgctgtaagtgctaatacttccgatgcaaaagagaaagacacaataaatatgaaaagcaatgatagatgaattttacttaattgttttacctttgtaaaacattagtgtcccattaaaattgggacgaattaaaaattaaataaacttggcccatttggtccgaatcgttctttgtcattttgaaatttagttttatcaaagaggtctctcagatgagtcttatcagtcaatgagatgctcagtatttgtaacacttcatatgtacttctgttcagttgcatatcgtgttgaatgattgccaccaaacagtaagcgcatatagcagcatatatctgtattcgaacagcattctctgtagttccccaaaatcttttgattttaaggtgctgcttgagccatttgaaaaacagctctacctgccagcgatttttataaagttcagcaacttgaagcgcagatatatgcatcgcattggttatgaatgtaaattctcgttcttgttcttcatcccaatatttaaccaatctaagtggctctggataatattgtttaggatagaatcctgtcagaaatacacttgcgtctgaaagcacattcttaggcagcctacgtttccattggatggatttgtacccgagattcttttttgctctgacaacaaagtaggcttcaatttgatgaattttatacagtattttgaagttgttataaccgcggtcaaagatgtaataagagcttggttcataaggaatttcaatcataactttagaatcgtgtacggatgcttccgtgatatgaaagaatgcaggaatctgtgtttccacatcatataatgtatgcactttgataccacctttctttttgcggaattttgcccaccaaaagactgaaaggcacaggtcaatagtagtcgaatcgaaagcataaacgttaccgccaagtttgaaaatatgattagcacacttttgtcgtgcttcgctaaccaggtagtaagcatattcttcaaagatgtgatagtctctatcttgatttgctcttgccagcgatgactttgatacatttttacccattcctaaatgataacatttggaatgatgagcttcaagagcaactatcaaatctcgcagactttcacgattagaaagttgaccaaacatcaaagcaagtagttgattccagcaggtgaagtgcttcacatatttatcaccatcatacttggtgactatgcggttaaacttacttcgattcagaaatgaagccaattgagcgaaaacgtatttgtcttggaacatatgccatcggattaatctgatgcaaagctacaaattcaagtccgttcgctcggaaaatcgctgtaactaactaaatttcaaatatttcaaagaactcttttagattttaatgggacaacaatgtttgtaaaaggtaaaacaatatgcgtttttcagatacagagaacaatatgaccttttgcataggtgtgtgttggttaggaactccaaatatggagtcgttgcagaaaataatgatgaacttgaatattattgataaggatggaaacaatggaagctaatgaactgatgcgatatgcctatgaattactgcaagggcattcgaatgaagaatgtgcccgaatattaagagaagtggtggccgagtgtcaggtgtgtataaagaactgtgaagaaggtgttttcgaaaatatgctaaagtaataacaacaagaatatggaaattactcataaaaatcaaggagaacttgactcaaccatgctcccattcgtgatgagagagctggtagaactggtcatgaagaaaaaggcattgcctttaggcgatgcactgtattatatatattcttccaagttgtataaatctttgctggataagagtaccaagttatggtattcaagtacattgtcgctttatgaaacattggagaaggaaaaaacagaagaaaaacgacggtataacggtgacacgaagatcctgcttttcaagatgttctgcattgagaattatagggaggaaaagaaacaaagtgcggaagaaaccttgttgttgttttcggactatggggtttttgattttttggatgagacttttgaaatgcttcatacccaagaccccgaatatatattagatactataacgacttatatcaataaaagaaaatgagactatttcatggatctacagttaccgtgaaacgccctaatatacagaaaggacggaaggctacggactttgggaagggattttatacgacaaccaactttgaacaagcaaaaaaatgggctttgttgaagaagaacagggaacagagcgaaaaagcaatcgtctctgtttatgaagttcccgatgatattcttgatagggaatatccggttcttcggtttatgggtgcgacaaaagaatggctggagtttgttgtcaacaaccgcagaggaagagaaaacggtgactatgacctaataatggggcctgtcgcaaatgaccagttatatgcgacaattcggctttatgaacagagagttgttacggctgaagccgctattgagatgctgaaagcgcataagttgttcaatcagctttcatttcatacggtaacagtcgctttgttgttgaagtttgttgaatcaattgaagtggggtaaagaatatgtgaagtgaaaatagggggaagtttatcccccaatggtaaggttgttttttgcgtccacttagttttttcccacccaccctttcagcggagtgactgcccggcagtctgttgcttacccatatgtcctagccttttagggctgtagataggtagttggatatttcgctgccaaatcggcagtccgcttcaatcgtttgcttgcttttctccgagtggagcctttctgcttttccggtggtgtaatcttcttttattggaaacaggtgtagtggctgtatgcctgtgtggttatgttctcccgcagaatccgcaagtcagttcttccgttgcagcttttcattttatcgtgcagtcacttttttcgatacgtggaatatgatatgcttcattcttcggcttcatttttttaaaaggaattgcagatgtttcttccggtgtgtcgataggcggctgaccatcttttcgggatgtgccatgcttgctgtctaaccggttgttttttgcatcctttccaaacctgttactgattttcaagttttgtctttttcatatcattttttagggaagtcaaatcattttccgttgcaaatatagattgttgctaaccccttttacggggataaggggacgattcacaaacaccacgttgttattcgtctgaaatcttcctttttttgccttgcacaaaaagcgtatttaacccgaattattcgttgccatcttcaccaataaaaaagttacaaatcttcctttttccggccagcataaaaagagtatttatatcttttttcatggtgtcccccaaagccaacaatcagttattgcactgtaaaattgattaattaacttctaaaaaatcagagatatgaaaaagattgaaaattcattcgcagtaacaggcaggatttgtagggatgcagaaatccatttattcgaaatagtaaaggttgcacacttctctattgtggtcagtcgcataggcaagataaatgaagaaaaaacatttgtttcctctgttatgaaagttgaagcctagagtaagatggaagaccgctatgctttttggatactgcaaaaagatgtactgattaccgttgaaggctactttaagccggaagaatggacggattctaaaagtggggagaaacgtaaccgcattgtgatggtagctactaagttctacccgactccggaaaaataagaacccccggactaaaaagaaaaagcaatcaaacgattgaagcggcacaaggtcgcttcaatcgtttgctaatgcggcagaagattataaaaaaagtgtttcttaatttggtgattttcagatttatcggtatttttgtatcaaaaatgatacctaaatatgtttttctatgaaaagattatatgatacatatacaatatacgaattttcagatgaatgtattgtaaaggaaatctgcaagagagttaagtctataagacttagctgctgtttttcccagcaagaatttgcggataaggcaggagtatctatcgttactattaagagaatagaatcttgtaaagtaagtgatattgccctaagtacattgcttaagattttgcgtataagtggaactcttgaaggcgttgtcggtttggttccggaacttccagactcccctttcctaatcaatgaaaaaacaggtaaaagaatacaaagaattaacggtaaacgtaagatggtatgaagaaagagccgattatagtgaatgtatatctgtgggggacttgcattggcaaattgaattgggactttgaaaagcattgttctgtattccaatttacggatgaatataggaaacaagattatgatatatgcccttccacacaccctaagagaacccctttgtttgcgtctttctatgggaataaagataaattatatcaagggcttccggaatttcttgcagatgcgcttcctgacaaatggggggcttccctatttgaccaatggctcacggataataatataaaggttacggaatcattgcctctattgaagctctcttatattggcaagagggctatgggagcattggaatttgaaccggaatttaatgatgatgccatccatgagtcagtaaatatgtcatcattggcaactttggcttctaaaatatataatgatcgagatgctgctgtcatatcaccggaggatagcctcacgatgaaaaagttgatatatcttggaacttctgccggtggcatgcgcccgaaggcagtgattgcctataatctcgaaacggaagagtttcgttccggccaggtggatttgcctgaaaattttaagcagtatatcatcaaatttaaagaagcagatgactctcctaccacagagatagaaatggtatatagcgaaatggcaaaggcggcgggaatcaacatgatgccatgcttcctgaaagaaattgatggaagaaatcatttcgtaacggaaagatttgatcgtaagaatggagaaaagctctttagtcagacccttgcggccattatgccgggtgcagatgattatatgaagctgtgttggatagcagagactctgaaacttccccaggaagacaaagatcagatatttatcagaatggtatttaattatgtcgcaggtatatccgatgatcataataagaacatatcgtttatcatggataaggcaggggtatggcgtttatcacctgcatatgatgtaatgttcacggcaaatacatgggaaaattcttcagcacacattcattcgatgggcgtgatgggcaaaaggtctgccttgactacaagtgatttcgtcaactttgccgaggattttgtagaggagcccgaaaagaagatattacaggtgttcgatgctgtaagcaaatttcaatcgttatgcgccacgtatggcatagataaggctatatttgataaaatccaacatgtattggatggattggtcactgatgatttggatttgctgcaattaacttaaagaacagtagatggtgatagttgctccagtcttttctggaacggctttcttttcttttgagatctttatacccctatttgttattttggagaaagtcacatgtttcccacccaccctttcagcggagtgactgtccccgtttcaggatttctcatagtcactcgcaggctccgtgattgtgtgaaatccaggaatggggaaggcaaaggagagaggcatatccggtctgctttcggagcttcggccacatcgagacaacctctttccggcggctatgccactctccttttatttgcccggcagtctgttgcttacccatatgccccagccttttagggctgtatataggtagtcggatatttcgccgctaaatcggcagtccgcttcaatcgtttgcttgcttttctccgagtggatgcctttctgtttttccggttgtataatcttctttttccggaaacagttgtagtggctgtatgcctgtatggttatgttctccccgcagaatccgcaagtctgttcttccgttgcagcctttcattttatcgtgcagtcacttttttcgatacgtggaatattgtatgcttcattcttcggcttcatttttttaaaaggaattgcagaggtttcttccggtgtgtcgataggcggctgaccatattttcggaatgtgccatgcttgctgtctgaccggttgttttttgcatcctttccaaacctgttgctgattttcaagttttgtctttttcatatcattttttagggaagtcaaatcattttccgttgcaaatatagattgttgctaaccccttttacggggataaggggacgattcacaaacaccacgttgttattcgtctgaaatcttcctttttttgccttgcataaaaagcgtatttaacccgaattatttgctgccatcttcaccaataaaaaagttacaaatcttcctttttccggccagcataaaaagagtatttatatcttttttcatggtgtcccccaaagccaacaatcagttattgcactgtaaaattgattaattaacttctaaaaaatcagagatatgaaaaagattgaaaattcattcgcagtaacaggttttatcggtaaggatgcagaaatccgtagttttgaaacagcaagcgtagcacgcttttctatcgcggtcagccgtgcagacaagacaggtgaagaaacctcttatgtttccgctttcatggggattgaagcctggagaaagaatgaagcactggattccttcgatgtattgaaaaaaggtgagctgataaccgttgaaggctactttaagccggaagaatggacggattctaaaagtggggagaagcgtaaccgcattgtgatggtagccaccaagttttatccggctccggaaaaagaagaagaaaaaccggatcagcctaaacagaaggctgtctctaaaaagaaaaaagcaagcaaatgattgaagcggcctagtgccgcttttttttgctacatatccgagagtgtttttgcgttcacgcagtattcttccccaccctccccttcatcggaatgactgttctcattcccggtttgcccgtagtcatccgctatgcggctgattatgggcaaaccagaaaagagaagttcctattcattatgctgaattataaagatcttcaatttttgaaaaatattgccttgaaacttattaaagagccagaggtaatagatgtgtagaaaatatgttatacgtagtcaattatgcgaatggcgaaccatacgagtcatatcgaaagataaatacccgtactgccaagtggttcggtaaggccgatagggttattgaatattcctctaaagatattccacagtcatacaaagaagcttataaggatatttttgcatataagcgcgggaatggactttggttatggaaaccatacttaataaataaagcattggatgaaatcaaaaatggagattggttaatgtatcttgatgcaggaacgactgtaatcagagatcttcatcatatcattcgacatacagaaggccaaggattggatatattcctcatggaacaaccattacttagtcgtcaatttacaaagcgtgaatgttatgtaaagatggggttggaggatcatggagaaaaccaggtattaggcctgttactactactacgaaaaagttccactagtgtcgcctttgtaaaagaatggttaaatttatgtgaagatgaagaaatgttatctccaaagaaatttcatcctgagatcgcagagtttcctgattatatttctcatagagaggatcagtctgtactaaatttgctccgattaaaatataatattcctgtatttcgtgattgttcatctcatggagagatgccatatttatattgtaataaagaatcaacttataaccccaagcaatatcccgattcaaattatcctaccataatattatgtaaccgagcatacagtccttataaattctttataaaatattgtgtgaaatcttttttactacgttgccacatcaacttttttgaaactcgctggattaataatcctccgtcaataccaatcaagaaatgaaaaaatatttcgtatattacatatttcttgtattttctattattattatatctttgaataatggacgtgcgcaatatgtaccgatgaatatttatttatttctcgctccgtttttattattattttcaagaaacattaatcgacaagatttattgccgatattgcttatcggttctattgcattaactatgtttgtacatccgaatgaatttcgcttgtcaacggttgcatattctattatgttcgttatttcctatatatattttacaaaacttgttcggtccagttctttttcgtatttggatttattgaaactctcaagatttgtggtactagcatatactatagtgttgttgtttcaacatttagggattttgtttcatttgcctataattaatgagaatccgggaattgagtacgatagttttaaagtaaattcattatcaaacgaaccttctcacactggcccaattgtagctatcagttttttttgttatatcaaaatgaaagaactgcaattgggaattaaacgtgtgtcttttagaactttatttatacaagataaatgggttataattagttttttttatacgatgttgggttctatgtcagttacatgtgtcttatctatgttgattatttcattatattttgtaagtaaacgacatctcttaactggtattttatttatatcggttctagttataagtgtaatatttagtgataatagtattggagagagaatccgaacattattaccgaccttattattactcgatccgcagactctttattatgtggatcctagttctacagcaagaataggccctattatgacttatatattagagttttcaccatttaacgtaaattgttggtttggatatggttgtgattatggtactcgtcatgtaatgcattatatgacagggaattatgttgaagacgaattcggagatatagggggggtaataaactttatatataactatggaatgatttcctttgttttgtttttatcaatgattgtaaaaataacgaagataaaaagctttatgttttttatctatatcaccttgtttttagtaagtccattcaatgtacatatgacatggttgttcattatgtatgtttattgtataaactattttcgaaatcaagaacctatatgcacaagtacttccattacataacatcattgtttccatcgtttattttttgcttaagagtacttccattccgacaagcaatcaagtgccctatacttattcataaggcaaatttgttatcatgcaaaggtcgcttccttataacatcacccaatataaaatttggtatgattaagatgggatttaaccttgtgcctttgtataaggatacgggtatcatgattcaaaacgatggtattgtcaaatttgaaggtaaatgtacaataggatcaggttcttcaataagtgtaagtcataaaggtatgctgagctttggtaaaagatttggagcctctgcagaatttcatctggcttgttataatgaagtagtattcagagataatgtgcttattggctatgaatgcttaatgatggataatgatatgcactccttaaaatatgtcaatggggggggtaaaaataaagcttatggccctattctgataaataatgatacttggattggtgcaagagtaacaatattaaaaaacactgttacacctacgaagtgtgttattgcagcaggaacaattgtttctggagatattacatcccttggtgaaaattgtgtggtttcgagtaccggaaaagtaagagtgattaaaaatggtgtatacagagacagttttgatgatagtatagataattagttatgaaagaaatatcaataataatagccacatacaatgcttccaaaacacttttaaaatgtctggacagcatcgtccctcaattaacagacgaatgtgaactcgtcattgtagatggtggatctaaagataacactaacgatatcattagagaatattgtgataaattgtccatctacattagtgaaccggataatggaatttatgatgcatggaataaaggtgtaaaattgtctaacggtcgatgggtgatgtttataggtgctgatgatattcttcttccaggtgcaatagattcatatttgaaatttatttcatcagtcaaggatatagagggttatgattatatatgtgcacttaatgagcatgttgacaaaaatggtaaactattacagattataggaagtgaacccaaatggagtttatatagaaagtccatgaatgctgctcatgtagcatctcttcataataaacataacttatttgaaagtattggttattttgatttaaactatcgtatatgtgctgattacgatttactattgaggaaaagaaacaatcttagatggttgtttattcccgtccacattgcaagaatgcaggtaggtggtatgagcttttcttttaaggcgatatttgaaacgtatcatataagaaaaaagaatcgctctgtttcaaatattcacaatgtttacttgttgattattaatacacttgcctactatcgttttagaataaaaaataatttaattggcaaaaaaatatgacttatttgacaattgcaataatagtgctagttttctttaaagactttattgtggtttttttactttctcctattgtaaagttctattttaaaataaaaagcattcggaatcatcctcaagaattatacgaaacagaggttgagagagggaacaacattaataaacagttttcaataaaagcgtacttgaatgggttatccatgttttattgtatgaaagtttcatcattaccttctcaatacattcgagtactatgttataagcaagtctgttatatgagcatagcagatagtgcgtgcatatacggaggtttggaaatacgagatccgtataagattaaaataggcagaggttccataatcggttctaatgtaatacttgatggcagaaacaaaatatgtataggtgagaatacgaacttctcctctaacgtatctatttggacagaacagcatgatcatagagatccttattttaggtgcgaaacacaacaaaaaaagcctgttgttattggagatagagcatggattggccctaatgccataattcttcatagtgttaccattggagaaggtgctgttgttgcagctggtgctgttgtaacgaaagatgtaccaccattttcaattgttggcggcataccagcaaaagtcattggatcaagaaattcgaatctgaagtatgaatttgatggacaatatttaccttttatataaactgagatgaatatattaattgacgcccacatattcgacggtaaatttcaaggaacccgaacatatattgaaggcctttataaagaactgattaatcatgaagacattcagttctattttgcagctaaacgaatagatatattaaaacaatgctttggagagcaagataatgtacatttcatagagctaaaatcaactaataaaatcaaacgtcttgtcatcgagtttctacaaattattcgaaagtataatattgattatgcacattatcaatacatatctccactcataaagacgtgtaaggagattgtaacggtacatgatcttctgtttatggatatgccggagtattttcctcgaagttatagatttaagaatgagttactatttaaacgatctgcaaaaagagcagacatattattgacagtatctgaattttcccgagatgagattgttcgtcattttggattaccttatgagaaaattggtgtcactcacaatggtgttgtattgccagaaaaagattttggcaatacgggaattttggatcaacttggtgtaaagaagtatatacttacagttagccgtatagagcctagaaagaatcatcttgcgcttctaagggcttttaatgaactcagacttgatacgcttgattataagttggtatttataggtggttatgattggtctgatagagtttttgatgcatatctgaataatttatcgcctgaagtaaggtgctcagtcataattacctctgtatcatatcctgagcttgttaatttatatatgaatgcatctttgttcgtatttccatcattaggtgaaggttttggaattcctcctattgaagcattagcgttcaactgccccgtattgtgctctaatgttacagcaatggctgaatttggtttgcctgcatcaatgacatttgatccccacgatctatcggagatgaaatccaaaatgatgcaaatgctttcaactcgttcggatatatcaaatatcaaacaaaaggttctgagtaaataccagtggaagacatcagcagaggtattatatgatagaattatagaggattctaaactggcaaagtgacactattgcaaccatcgataaggttaataaattgattgaatattatggaaaaaattaaattagcaataataggagctcacgggcttcctgcaaaatatggtggttattgtacattggcagaatatttggcagagcataggccagaagactttgatgtaacggtttattgcgtggcggcagaatacgatgagcacccaagcatgtataagggcgttcaccttgaatgggtcaattattctgcacgtggcatgatggcatggcagtttcataagtatggacttacacatgctatttctcatgatgcagactgtatactattatgtggtccaaacggaggcttcatattgcctttctatcacaaatatagagaacgatttttcttgaatattggtggaattgaatggaagcgtaataagtttaattggttcatgcaacgcgtgatgcgtgtcctgatgaaaagtgcagtgagaaactgtggttatcttgttgcagataatataggtattcatgattatatgattggagagtatggacgtgaggatagtgttgtgattgcttacggtggtgatcaggcaaagaaaattgagcttactccagaagtaataaagaaatatccgtttgtgaatggtagatatgcagtagctatagcgcgcattcagtctgacaataatgtagaaatgttgctggaagcattcaaggatgcaaagatgccacttgtttatatcggcaattggaatgtaacgctatgggctcaacagattagagagacgtactcaaaatatagaaatctgatacttttagacgcaatttacgacatccctgttttgaaccaaatcagaagtaattgtgctatatatgttcatggtcactcagccggaggaaccaatccatcactagtagaagcaatgcatatagaagtgccgttagcttgttttgataatggatttaacaataatacaacatacagcaaagccctttacttcaaagatgttgagagtttgaagcagatagtgaatgaaacgatgcctgaaaggttcagtgaggttgccaaagatatgaagcgacttgcaatggagcattatacatgggagactattgctgctcagtactatgaattcttccgtaatcgcaagttgtaagttagcatccaaaaatgacatataggataaacgacataaaaggcagaactttgcttccgttaaatcaaaagcaaagtttatgtatagttataatgattttcagcgtctgtttgtgcgctataaattggaaggtgtcccttctggtgtttcgattgagcaattctgtttgtcgaaccaaataccttataacctgtttgcaaaatggtacaaggatatccgaaaggagataaggaactccggaagtggacacccggctttcttcgagtaccgaacttcaaattctggtggacatccgtatgagcaatggtgttcatatcagtcagaaaaatttaagctacgcaggtttgaaaagcctgatagagaaactggaggtcctatgttaaatataaccggtctcaaccgctttttctttgtccgcgatttccacgatatgcgctgtaaatatgctaaggttttgtccatcatccatcagcagttgaatcgtgaaccggaagacggcgatgttttttcgtgatgtccaaagatttacgtctgatccgcttattcagtaatgatcaactgtcttacagcatgtttgagaagcgtttcaggcccggatacaagtttatgcatgtaactgctttcttccgcaaggaagctgaaggaacgggagggcactcctgtaccttttgaagacccatattcagatatgacacccgaagagaaatcgaaaatgataatggagctgatggttgcccgtgagcgggatgccgaacgtatccagcgtgacaaaacccgcatagacgaactgttgtccaaagttgacgagcagttgtctttgcagaaggctgccatggctgcagaaaaagagcgggatgattataaagcgatggtcagtaatctgttgtctaaaataacagctttggaggagcggctaaaagtccgtaataagaacctttatggtggtaagagccagaaggggggccgtaaaaagagtgtgaaggacggagaggaccatgcccgtgacaaggatgattcgacggtactccgcaatccatcgggtctccgtctctggatcatggtggggaagcggtgcaggaagagggtgcgaaagcaaaatcaaaagagtaccgtctttatcgccagggactttcttatcggaccataagtgctgacaatacggtttgtcacaacagtgatatccactatcagacatcggacgggaaaatccgcaaaggatgttataagaagaaatatatatggtgtctggtcaacaaactctccaaagtggtaacctattgctttgaggacgattccagaggacaggatgccctgaagcatatcctgggtgacagtcaggtgaaagcccttcagtcagacggatacaatgtctacaaatattaaaaatcagtatcttttttgacgttatttattagaaaaccgccttgtggcggctttccttgggctacatgtcaaaattggatgcaaactactggacgctaaccgctaaccatttatattcttaattatcatgtggtatgtacataagtatattattttttgtaccttttgtgaagtcgttgaattttacaatatatgtttgttttatgaaaggcattgttttagccggtggttccggtactcgtctgtaccccatcaactacagtataaccgcagcgggtaccggtaaaaccggcagttttggacagggagcataattcgatagcgcattttctggcgtcttcaacgacaaaaatactgcgcgggatagcaggatcatcaacgaacgcttcataagcggcatcatacaggatgaccgcgtcgtttttcaatgcataagcgacccaggcctccagctgctctttggtataaacagcgccggtaggattattcggcgagcaaagataaatgatgtcagctttaacgctgtcgtcaggcattggcaggaagttgttttccggcttgccgtccatataaactattttacggccgcacatgatattggtgtccagatatacaggatagaccggatcaggaatcaggatcgtattcgcattgctgaaaatatcggtaatattgccgcagtcgcttttagcgccgtcgctgataaagatttcatcgctggccaaagttacgccgaagccggcataatattttacgatagcttcgtgcaggaaatcatagccctgctccggtccgtagccacggaaagtttccttcacgcccatttcggcaacggctttctgcatcgcgtcgataacggccggcgccaaaggcagggtaacgtcgccgatacccatacgaataacctttttctcaggatgttccgctacataagcattaacctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattgaccaaatgggtaagcttcagagtgccgcctttggcgataactgttaattcttcaccttttttacctgcatggcccaacatgatagtagcaacacaaactgctgtcgcgccggtgccgcaggcccaggtttcgccgctgccgcgttcccagacgcggaatttaacggtatttttatcgattacctgcacaaattcagtattgacgttttcaggaaataatttgtgtttttcaaatttaggccctaatttttccagatccaaagcatctacatcgtctacaaaggtgacgaaatgcggattgcctacagaaatagccgtaccattataaacaacgtcttcttccagcaccagtccctgatctacaaacataaagtgatcgctgatcatggggatgtcggcacatttaaaaataggctcgcccatatcgatactggcttctgccactttaccgtcttcacccaaaaatacatcgatggttttgataccggagagcgtttccagcgtaaaagttgttttatccgtcagacctttatcataaacatacttggcgatacatctgctcccattaccgcacatcttggcttcagaagcatcagcgttaaaaatacgcattttaaaatccgcaacgtcagatttacaaatcatgatcaggccatcactgccaataccaaaacgtctgtggctgatatattcggaaatagcgcccggattaggtaattcctgttccatacagttgacgtaaacataatcgttaccagtaccgtgcatctttgtaaattccattttcatggcaatatcctcctaaataaattcatagcttgctttatattataacaaaaaacagacaaacaatacagtgattaaaagccccttgtgttgttccttattaagaacactattcttcatcttcatatagtatactattagcgtaggctaacgtcaagtaaagattagaaatttatctaacataaaaaaataannnnnnnnnntttttagtaaaagatatttatttttgtaaacttaatgtatcatttttacatttttgtaatttttcataataatctaaaatattggtactttgaataagctttttagtatttgcaaactatgtcatttcaagaatcatatataatgcttattttaaaacagacagttttccagtacacaggcatgcaacttccgcttttgcctgccatgtgtcccagggcaaggtctggccggatagtattttcatcacataaaaaaataaccataccgtatggtatggttattttttaaccggcagctttctatcctcccaggccgcttccagccaagtactttcgacgtttaagggcttaactactgtgttcgggatgagaacaggtggatccccttagctatcgccaccggattgtttcagaaggtctttaagccttcaaaactatatagaagagtacaaacttttgagtttgctgtgtgtttttacttcttttcggcgattcactttcatcgaaaacgctcccctcaggtcgctttttcgatataagttcaacctttcctgccattggcttcgcttgcgcttgcctctgtcagggcgtcacttaagtcaagccctcgacatattagtatcggtccgctcaatacattgctgtacttacactcccgacctatcaacctcatcttctttaaggtgtcttactagattgctctatgagagatctcatcttaaggctggtttcacgcttagatgctttcagcgtttatcctttccgaacgtagctacccaactgtacccctggcgggataattggtacaccagcggttcgtccactccggtcctctcgtactaggagcagcccccttcaaatctcttgcgcccgcgatggatagggaccgaactgtctcacgacgttctgaacccagctcacgtaccactttaatgggcgaacagcccaacccttgggaccgacttcagccccaggatgtgatgagccgacatcgaggtgccaaacctccccgtcgatatggactcttgggagagattagcctgttatccccagggtagcttttatccgttgagcgatggcccttccactcggtaccaccggatcactaagccctactttcgtacctgctcgtcgtgtttgactcgcagtcaagctcccttctgcctttacactcttcgcgcgatttccggccgcgctgagggaacctttgggcgcctccgttactctttcggaggcgaccgccccagtcaaactgcccgcctgacactgtcccggatttcgttactctcgcggttagaatttcaatacatcaagggtggtatcccaacgtcggctccagccagactagcgtccagctttccaagcctcccacctatcctgtacgtaatgtatcaaaacccaatgtcaggttacagtaaagctccatggggtctttctgtccagtcgcgggtaacctgcatcttcacaggtatttcaatttcaccgggtccctcgttgagacagtgcccaaatcgttacacctttcgtgcgggtcggaacttacccgacaaggaatttcgctaccttaggaccgttatagttacggccgccgttcaccggggcttcagtcgaatgctttggactaatccgaacatccttccttaaccttccggcactgggcaggtgtcagcacctatacgtcagctttcgctttagcaggcacctgtgtttatggtaaacagtcgcttgggcctcttctctgcgaccactctatgctccatccgcatgggacttcacaacagtggctacccttatcccgaagttacgggtacattttgccgagttccttaacgagggttctcccgcgcaccttaggattctctccccgcatacctgtgtcggtttacggtacgggcggtagctctctcactagaagcttttctcgacagtgtggggtcaacaacttcgctcgcatctctgctcactccgcatcacgcctcaggctttcagtgcacggatttgcctatgcaccaccctacacgcttacacatgctcttccattcgcatgcttgcctgcccttctgtgtcactccattgctcaaacaattactaccggtactggaatatcaaccagttgtccatctcctacgctctctgcctcggattaggtcccgacttaccctgagacgacgatcgttgctcaggaatccttatgctttcggtggaaaggattctcacctttcttttcgctactcataccaacattctcacttcccacaagtccaccgaaccttccagttcgacttctaccctatgggaacgctcccctaccccgtatactttacgtatacagccacagcttcggtttcgtactttagccccgggaatcttcggcgcagggtctctcgaccagtgagctattacgcactctttaaatggtggctgcttctgagccaacatcctggttgtttatgaaaccccacatccttttccacttagtacgacattggggaccttagctggtggtctgggctgtttcccttttgaccacggatcttatcactcgtagtctgactccaaggctctacagtatatccattcggagtttgacagggttcggtaacctttacggcccctagcccgatcagtgctctaccgcctatacttactacctcaggctagccctaaagctatttcggggagaaccagctatctccgcgttcgattggaatttcacccctacccacatctcatccgaaagcttttcaacgctcaccggttcggtcctccacgcaattttacctgcgcttcaacctggacatgggtagatcactgcggtttcgggtctacctacactaactagcgccctcttaagactcgctttcgctgcggctccgtgtcttccacttaacctcgctagtgcagataactcgttggttcattcttcaataggcacgccgtcgctttcgcttcgactgcttgtagacatacggtttcaggtactatttcactcccctcccggggttcttttcacctttccctcacggtactatgcgctatcggtcgccaagtagtttttagccttggagggtggtcccccctgcttcccacaaaattcctcgtgcttcgtggtactctggatctcggcctctctgctctgcctttcgtctacggggcttttaccctctctcgcttacctttccaggtaattcaactaggcctgacttcgattctgccggtcctcaaccccgaaaagccggagcttctcggtttgggctctgccctcttcgctcgccgctactgtgggcatctcgtttgatttctcttcctccgggtacttagatgtttcagttccccaggttccctcccttgcgggtgaccatccatgacgatggccgggtttccccattcggatatccacggatcaatacttgcttgcagttccccgtggcttttcgcagcttaccgcgtccttcttcggctcttggcgcctaggcatccaccgtatgcccttagtagcttgacttttcagctgctaagaaacttacgttcctagacttttctcgttaactctcatcaaatatagcattttgattagaggtttgtgtctattactactcactcatcattttcataataaactgtttgtctcttctatatggttttcaaggttcaaaaaagaaggctaagccttcaaaactaaacattaaccaacgaatgtgcgtcgacttgaagtctacgagatatcttactatctcatgtctccatagaaaggaggtgatccagccgcaccttccgatacggctaccttgttacgacttcaccccaatcatcggccccaccttagacggctggctcctaataggttacctcaccggcttcgggtgttaccaactttcgtggtgtgacgggcggtgtgtacaaggcccgggaacgtattcaccgcagtatgctgacctgcgattactagcgattccgacttcacgcaggcgggttgcagcctgcgatccgaactgagatcgggtttctggggtttgctctgcctcgcggcttcgcttccctctgtttccgaccattgtagtacgtgtgtagcccaagacataaggggcatgatgacttgacgtcatccccgccttcctccaggttgtccctggcagtctcccatgagtccccaactttacttgctggtaacataggataggggttgcgctcgttgcgggacttaacccaacatctcacgacacgagctgacgacagccatgcaccacctgttttcttgtccccgaagggaaatctctatctctagagcgttcaatcaatgtcaagccttggtaaggttcttcgcgttgcgtcgaattaaaccacatactccaccgcttgtgcgggcccccgtcaattcctttgagtttcaaccttgcggccgtactccccaggcggggtacttattgcgttaactccggcacagaaggggtcgatacctcctacacctagtacccatcgtttacggccaggactaccggggtatctaatcccgttcgctaccctggctttcgcatctcagcgtcagacacagtccagaaaggcgccttcgccactggtgttcctcccaatatctacgcatttcaccgctacactgggaattcccctttcctctcctgcactcaagcctaacagtttccagcgccatacggggttgagccccgcattttcacgctcgacttattaagccgcctacatgctctttacgcccaataattccggacaacgctcgccacctacgtattaccgcggctgctggcacgtagttagccgtggcttcctcgtttactaccgtcattgcaatgcattgttcacacactgcacgttcgtcataaacaacagagctttacagaccgaaatccttcatcactcacgcggcgttgctccgtcagactttcgtccattgcggaagattccccactgctgcctcccgtaggagtttgggccgtgtctcagtcccaatgtggccgttcatcctctcagaccggctactgatcatcgccttggtagtccgttacactaccaactagctaatcagacgcaggcccatcctttagcgatagcttacttgtagaggccatctttcttcatcctgccatgcggcaagatgatcacatccggtattagcactcctttcggaatgttgtccccgtctaaagggcaggttgcctacgcgttactcacccgttcgccactaagaattctaccgaaataaaattctccgttcgacttgcatgtgttaggcacgccgccagcgttcgtcctgagccaggatcaaactctccaataaagttttattgagaaagccgattggctctttcgatttgttgttaagaaattatttttgacttggcaaacgctcctctttcaagaaacgctcgcccgcacattcgtttttggttattgttcagttttcaaggttctgcctgccgccgcatttcggcgacttgtatataatagcattccccgttacttctgtcaacaccttttttacaacttttttatgtttttttaattattttgtaagtacttactgatcaatggtttaacgatacatttaccgttgctgtaatccgccataaaaaccactctttccgcaactccagaatacacattatagtcaaacgcttcaataggataattcttacgtatctgcctccaggttgaaaaaatataatccggcaaatattgacgaacctcgtctttatcccgccaaaaggccatagcacgttcatttaattcagctgttttccatcccatccagctgggaagccagttaggctgagaaacaaatacatcaaatcttaatatttcttttacatttgttttttcggaaggataacagtcacatgtaaattcccacaacaattttgttacaccgcgagcattatgtcccttcagatttcctttattccccggaccatgaatcatacaaggacgaagaatatacactgtaggcgttaatttagcggtatcattttcttgcatagttggatgtcccatatgcaaaatctatttagtagatcatggataccgaaattttaaggaaaaaatacactttatggagtaatatcgttgatcttcgttctcgaggtatcaatataacaagaaccgcacatcgtcttggtgtttcacgcgatacagtgagacatctgcaatctttaacttcagatgaacttgttcgggagtgtcagacccaagagggaaacagatataaactccagaactacgagcgtgagatcctctctttacttatcagttttccttccatttcaagcagccgtgtccacgaccatttaaaggaacacttttcctccttcccacaagtctgtgagaagactgtacataattacgtgcaattcatccgaaagaaatatgatattccttcgggcagataacagtccggtcctgctattaatagcgggttccggatcatcatatacacatctttaatatagcaaacatcataagttgatcagaaataaaggataaatatggcctggatggtaacccaaaagaatcttaagattcatacctgcattgacggtatagattcagttgaagatgccagagtggtaatctcgcataagaaattgaaagctcttggtgcgaaacgtagagtttataaagacacgaaagagatcttttttcttattgaatccgattgtgaaataatcctctaaacttgaaggaaggaacattatgaaagataaggtaaatgaacttaggactctgttaagtgatttagatacattaatttatattctttctggtggcttcaaaaaaacgtcacttgagggcaatggtactgtaaaagaacagattgcatgttataagactcttggaactgatattcagtccttgattacagagatacttgaagagaatggagatgatattaactcatccagagattaacgaatacctatacagatatgaataaatcaacaaataaacatcgtcataaatgggtagagcctttcgatgctccatttacctatatatgcagtaagtgtggtaagcataagattaaagaaactatgtacactgcgacttactatgatgagaatatgaatccacttggcagcaaatcgccggagtgtgttagtaaataaccctcaataccatacagcaatgaaaacaaaatttgtaaaaacgacagaccgtaaaggcacttatatcattgaaggttcatctgatggccagttctttaatataaagaggttcatttgtcaagttcaaaaacaagaaaccgaaaaagagacgcaagaattagctgattttattttatcaaaacttaattcctaaccgaatagaaatgactcagatccatttatgtgagatgtgtaagtattgtacacattcgccttcggcggatattgggcctgaacactcagaaagcagataaaaaaatggatgagcagacgcaaaaaccaacctccctgaatggctattgaaaatacagagggctatcctcttatttcatggagagaaacaataattaaaactaaatatatgaatacccaacgtcaaaccggtacctgccgctctctttcggggcatgcacagcggcatgggcgcgaggtccgtccctcttatgagatcagcacttcgcaattttctgatatgaaagtcaggagactgacgcgtaattacggattcggtggatacagcatctaccgttatctggtgagtgaggccctctacaagggggagtatttccttccctggtgtgaggagaccgcgcgtgcggttgcctcttactggaatgcctctttggaagacattacccggatcgtggacggttgcgtacaggtcggcctgttcaatgacgaactgtacaggaagcacagagtactgacttctgccgccatccagcaggactacctcaagttatgcggcatgacctacatccaggaggagttcgctctttcggccagttgattcataaggttattatccactaataaatacataagtttatgccaagaacagctaaaaaaggtttcacctattacgggttcgataccgatcatttttatgaccccaaagtcaagagactcaaaaataaattcggcatggaaggctgggccgtgttccatttcatcgtgaacgagatccaccgcgtggaaggctattacatgatcatggactccgacggcctgttcgacgtctcggactattcccgcatggacgagcaacgcatcgcgggtattgtcgactattgcgccgagctggggcttttcgacaaagggctttggcggagccgtcaggtcctcaccagcgaggagatacagaacaggtatatgggcatctgcaagtcgatccaccgcaagccttccatctcggatgactacctgcttttgaacgcggctgccccggccaccacctcttccccgcaggttgccgctccctgtcccgccacccatacggcacctgttgcggaacccgtgcggagtggcgaaaaagagaaggatacggaactgatgcaagccattgcggattttaaacgcaggctgcaagaaccggaaagcgccgccggggtagttcgcgaagaatcgggaataattcgcgaaaatagaccacaaaataaaagaaaagaaaatatatcctccccaaacccctccggagagtccggctacactccggagagggaggaggagagaaattctctttcagggaagctccaatatctgggcgtggattccaacatcattcaatgggtacggctcctgaaaagccgttatccggatttccctatcgaaaaggcgatctctgacatggagcaaagcaatttccaactgaccaaggaaaattacctgtatcccctgattaagaactatatagccaagtataatgccgaacacggaagtgaagagcgtgccaggcaacaggaggagatcctgcgcacccggcgtaaaaccctcgagctcctgggcgttccggtgaaggaccagcaggaaatcctccagcttgcctccgttgcacccttagtgctggatacagccttaaaggaaacctggggaaacaaaaagatcaaaagccctaccatgttcctcctgagccggatgcggaaggccgtatcagcataaatatcaaaagattaatcatatggaattcaaagaaatacaagtcgaaatactcaggggaagttgcaactttccttccggaagcatccatctgtcggatggaagtttggagaaggtatggcactccgtggcctgtcagccggactttccggaattcttcacaaggaatatccgggaggccgggggtaacgaaagacttgccagggtatacgccattctacgggtggatgcaaggaataccggggaaccgatagtcagtatcagtttctaccggtacaagagctttcctccaggttttatttgccggtatgaacactgtgcccttcccgggacggaattcagaaattatctggaggaactctccggaaagacgcaagaatccgtctcctgtgtcatggaaaaagcgaggtacctcatgttggcggcgattctgctttttctgcttgccagatttgctgttgtccctcttttcgggctcagtccgacaatattctggttgtatgtgccttccataatggcattttttacggcaatatttttatcggtacagcgggtttcttcctgaagcccccgaagagtgaattcttagagaactataacaattatatgattatgacatcacaggaagccaattcaatcccgttgggagatattctttcccgctacggttacgaaccgtccagacggtacgggggatacgacatgtaccgctcccctttccgacgtgacagctctccgagtttcaaggttttcaagaacgagaaccggtggtatgattttggggacggcagtcacggcagggtcgtggatctggtcatgcgcatccagaactgctctttcccgcaggctatgaaagagatcggggaattaggcttcggcggcatagtcccggtacaaaggccggcagcggcggaggaagcggtacagcgggcttcttcaatgaccattctgaaagtcattcctttggagaacaggcacctgcttgactatgccgcttcacggggcatcgatgcggatatcgtccgtggccactgcgtggaggtgcattactgcttcgagaagaatccccgcgagaaatacgcgttagggttccccaatgatcacggaggtttcgaattgcgtaacagcatgtttaagggatgtgccactgccaaggacattaccggccttgctgcgggtaacaagtcctgtgccgtttttgaagggttcttcgacctgctgagtttcaagcaatacgcgaaggatcatcctgagatgccggcactgggaaagttggacctgtgcgtactgaactccacagcaatcgttgacaggtcaaaggattttctttcaaggtatgaaaaggtacacgctttcctggacaacgacgctccgggacgcgaggccctgagaaagatacggcatttccttcccaaggacacggtattggtgaatgaggcggaacgcctgtatccgtcatgcaatgacttcaacgagtttttgcagaaaatcaagtgcccggtaagcgggcgggaaatgtgaagagccggtaaacgggacatttaaccggcaggatttacgaatcgataacaaaatagaataatgaaacaggaaaatgacataccggacaagatcctggaacgtatccggaaactgatacgcctgaaggaatcaaccacgtcggaaggcgaagccaaagccgccgccacgcacgtgaaccggcttctgaaagaatataacctctctctgcttgacgtgaacgaaaagcggccggagacggtgtttgaaatcagggagtccggagcgatcagctataaggacgcattcggcaactactggaagcgtgacctgctgcgcgtgctgtgtgaatacaattactgccggatgctccgttaccagggaaccaccgacatgctgattgtgggtacgcaggagaatattgccgctgtaaccgtactttatgactacctgcgtacggctttccgccgcctggcagataaaaggcacatggagtatgtatcgaccaaacggggatattaccgtactgagaagtacaggaaaaagtatatacgttcgtacctcgaaggcgtgacaccgggactaagagaccagtttgaagcactccggtgcgctccggcggaggaagtgcgtgaaaccgctctggtgcattgccataatgcccttatcgagagatacctggaaacaatcgggacaagtccttccaaagtgcagccaagaaagtcaaagaccgactattcggcttatagctccggaatgggtgacggacggagtatcagcctgcaccgacaaataaacggaggaaatgtatgatgacagtatggataccgcttaccgtcctgtatatcccggtcatcttatggatgggataccaaatcaaacatgcccctactgacgtggagttatggggcgaagaaatagaataatgcataaaatgacagaaatggaaattacatataacatacagacagtttacacataccacgagaaagacatgcccgccggtaaaacgaaagtgcacattttctcccggaaagtaagccggaatatttgggagtacgcactgtcaacccccgacttccgctcttttctggaagcaaaaagccgggagtgctccgatacaatctcccaaatgaaccaggtgctacggaacgtagtcatcacatttcatgtctcctttaatggtgataccccttttgtggggagtgtagtctgctttttcaagacagtctcaggaggcgaactgcgatgcaggtacaaccggtccatccaatttgaggaaatactgcctgccggaaagtatcttcggaacgggtttatagagggaatgatccaaaaggaaaggcccgagaattccatcttttggccacttctgtttgtagtttctatctttttggctatcggaatattgacggcaccctttgcgtttaatctggaacgatcccctcttgtaccggccggaattatggtaatcatagccctcatgttactaacggcctgtctgagacatataaaccgtagacgtatcacgcggagaatggagatacaggataaaagacaggaacccattaaataacagccatatgtatttcatacactccatacagacctatacatcggtgaaccggaagggaagcgagctccaggaatatgtcctgaagcttaaggacagcctgataaagaacagggaggttctggatgacctgaaagaggaactccactgccggattgaggaacttgacgccaagtatccacgtacacaatccttgcatctggatgcggcaggcaaccgggagatccaatggaccatccacgtgaaaggaaagccggataacctggtatgtattatttcgattacgaaagtaagaaaccttctgggagaaggaagcggtttctttctcggggaaaagacaggaggtaaagaatgaagggcacatactggtatgccgtggactatgccggcacggggcatctttttacctacaagcccgaaagggataccgggatctggaatggagaggaagccctgcaggtttcccaagggacactccaggaagtatttcctaaaatcacctggcaggactcgcccgtagtggtaacactggaggtactcccctgtgaggagaccttccgcctgcgcctgtcaaagagctgtggttatatcctgagaaaatatctccgtttcccccggaaagaaaaaaacaaatgatttaaaaaatgaaggaacaagattgtgacaaaaaaaagagtatcccccagggaaagaaacacagcatcttttataagatgattatgaaccgtaaagccttgggaataacttatctggtatatggagcgacagtcctttgtatcctcgccgcaagagcggaactcctgtcctccaccccttccgtgggaagccggatattccttttactgagtatctgttttcctttcgtttacggcacatacctgctttgtaccaaagatagaaacaatacagaaacgcattaaacagccgtaagtattcgataaactccctcgtataatgggtaacgtatgttcataatatcgtttattcatgactcgccaaattatatgcataaaaagaaaagccctcagatttttacattgatccgtcacttttttcttattcaggcttgctaatatttatgcttaaaatttaatcccctcaggatttccgtatgagcccagatttttacattgatccccttgctttgcttattcttggaaatgaaaaatccctgaacttctttgaaattcaaggatttacatcgtttttctttcttaaaaagtggtgccaccaggaatcgaaccggggacacaaggattttcagtcctttgctctaccaactgagctatggcacctttcttgtttgcggttgcaaaggtagtgaaagtttttaattctgcaaatcttagcacaataaaaaacactgataaaaagctatattgcttattatcagtgctcttattactgaacttttttatttattctcttgtagcggattccatccctgagcttttagctcgaattcctggccatcgcgtgtgataagtgcacagcctaattcgggctttgtgatgtgaccgatcaaacgaacaccttccatttccgatatcttttcgtgatcggcaataggaacggtgaaaagcagttcataatcttcaccgccattcatagcacatgtggtgagattcatgttgaactcttctgccataacagctgtttgataatcaatggggatgtgttcctcgtagacgcggcaacctgccttactttgagtgcaaatatgcaatagttccgaggaaagaccgtcagaaatgtccatcattgaagtcgggacgatatttgcagtagccagtttctcaataatgtctttgcgggcttcgggtttgagctgacgttccaacaaatactcttttccggagaaatccggctgagcatcctgttcacctttaaagaccgctttttcacgctctaacagttgcaaccccatataggccgcacctaagtcaccactgacgcaaatcagatcggtgtccttagcaccgttgcggtaaactactttatccttatctgactcaccaatgcaggtgatgctgattgcaaatcctgtcaaggaagaagtagtgtcaccacctacgatatccaccttgtattgctggcacgccaaacggagaccggcataaaattcatccatatcttccacgctgaagcgtttggagagggcaagtgaaactgtgatctgcttcggtgtcccgttcatcgcatagatgtcggagaagttgacaacagcggctttgtaacccaaatgtttcaacggtgtgtaagtcaagtcaaaatgtaccccttccattaacaggtcggtggtgaccaatacctgcttatcggcaggataggagaggacggcggcatcgtcacccacaccatatttgctcgattcgttttctaatttaattccttcggtgaggtgcttgatcagaccgaactcacccaaggttgctatttctgttctcatatatcttagtttatgaaaaaaaatatctatgcacggtttatcagctcacgcataatggtggtcattttcggttgggcagcgtcggctgctttctgaacctcttcgtgtgatacttctacaatcttgccttctactccgagatcagtcactactgatataccgaataccttaatgccacaatggttggcaacaattacttcggggacagtagacatacctactgcatcggcacccaagatatgaaacaacttgtattcagccggtgtttcgaatgttggaccctgtgtaccgatgtatatgccatgttgcactttaatacctttttctgctgcaatagcatctgccttgcgtatcagttctttgtcgtaggcttcactcatatccggaaaacgcggcccatacggaatgtttttaccccgtaggggatgttcggggaaataatttatgtggtcggtaataatcatcaggtctccgatttcgaagtcgggattagtaccgccactggcattggatacaaataaagttttgatgcccagctcacgcatcacacgtaccggaaaagtcacttctttcatggagtacccctcgtagtaatggaagcggccttgcatcgccatgatttctttattgccgagtttaccgaaaatcagttttccgctatgtccttctacggtagacaccggaaagttgggaatatcctcatactttatttcatacttttcagtaatttcgtttgccaaactgccaagtccggttcccagaatgattgctgtctcagggcttgtgtgcatcttccctttcaggaaggctgccgtttcttgtattttctctaacatagccaataatgtgttggttaaaattatcttgttgattttgtaatatttctacttcgatgggcagggcataaataaatggttttagttctgcatccagtgcccgatggtctatcagacgggtggcatctttctcggtagtgataatcagacgccgtccttctttcaaattaccgaacttctctttaattagcgacatgtctcgctggctgaagctatggtgatcgtcaaaagcgagtaggtcgatgttccgtgtatacatttccagttcccggatgatagcatccggagacgcgattccggttatcactagtatctgttcatctgcttgcaaggacgatagttccctttctcttacggcagtacaaacaggaaagaccgcttgtaatttgccgtatcggaatgacgagaaataaagttgttgataggggaatagattcaaccgttttgcgatgatattatgatcgataggcttgatatccggcggacatttggttacaatgactatttgtgccctgtttttcccccgggtagattcccgtaaacgtccggcaggcattaaagcatcgtcacagaacaggcgatgataatctgtcagaagaatattcagtcccgctttcacatatcggtgttggaatgcatcatccagtaagataacttcgacaggaggctcttgcaatgtgagcaatttttcgataccatgacaacggtcttcgtccactgcaactcgtatgtcggaaaacttcgattttatttgatagggttcgtcaccaatgctacgagcattgctctctgctgttgaaagtatgaatcctttcgtatggcgcttgtatccacggctcagtacggctacccggaagttgcgatggagcagctttatcagatactctgtgtgcggtgttttgcctgtgccgcccacggcgatattcccgatacaaatcacgggaatgttaaaactctttgactgaagtttaccccagtcaaagagtttatttctcagtgctactcccattccatagagccatgaaacgggatatagccatttatgtatcttaatagagctttcttccatgtagttcgctatttcacattcagttcaaacgggacacgtgcctgaatcatggcgcgttcttttatatttcttaatagattgaaatccttgtaatagtctcctaactggcttttcagcacttgggattctacatagttattgggttggacatcgagtaatgtggatagaatatcctttttggtaggataagatacaatggtatagcctttcaattcggctttccgtgctgcaatttccagtgctttgtcgattccacccagttcgtctaccagtccgattcctttggccatttctccggtccatacgcgtccttcagctattttttcaataccttctttggtcatatggcgaccttcggcacaacgacttacaaacaggtcatatccctggctgatcatcatttgcagcaatgctctttcatcaccgttcacaggacgcatcaggttaccgaaatctgaaaatttattggtttttaccacgtcaaatgttagtccgatcttttccgtcaatcctttgacgttcgggatcatgccgaaaattccgatagaaccggttaaggtagttggctcggctatgatgctgtcggctgcgcaagagatgtaatatccgccggatgcggcatagtcacccatcgaaacaattactggtttgttagcttttaattcttttacggcatgccagatctgttcggatgcaaatgcgcttcctcccggagaattaacacgcagtacgactgcctttacgttatcatcctcttttagcttacgcaggtcacgaatcattttgctccctacaattccttcgtcggatgtcgccgatccgtcatagtcagttatttcaccggatgcatagtagacagccagaatatcaccgcttttatctttaggtacactctttttgatgttgatcatatcatcgagccctaatatcggcaggcggtcgtcttcgttgatttttacaagtgttttcagatagctgcgtacgttattctgataaatcagggtatcggccaatccgcatttcacgctttcgtccgatgggtaaaacataagcatgcgatctgcatacgcattcagtgagtctttttctattttgcgtgaagccgaaacaccatccagtatttggttccaggttgaaccgatgaatgccgtaacttgctctttattggccggagacatttcggttgaagtgaacggttctacagccgatttgtaagtacctaccttgaatacctgcatttcaattcccaatttctgtaataggtctttgtagaaaatgggagctgaagcgagtcctcgccattcaatcatgcctttagggttaagcattactttgtcggcaacactcgataggtaataaagcccttgcgtataattgtcactgtatgctacaacgaatttgccactttccttgaaatcttccaaagcggtccgtattgcctgtaatgaggcataaggggcatccagccatgaagcctgtatataaatgccttttatattatcattttctttagcttttttgattgaagctaatatgtcgtccagtccgtatgtgttgcccgcttcaccggtgaattttcccaatagcccttctaaactctcttgagtgcgctctaccaatgtgccttttaagtcgagcatcattacggaattttttttcactactgtttcggtatccgatgacgaaatgatgccgacaagcgtcgcaattccgatgataaacaaaacaatgcccgatagtacgataccggtcaatgtagcaagcgtaaatttaaagaaatctttcattgtacatattgtttttatgccagcttttttaaagctaacaaaggtaaataattgagttgaaattcatcccataagtcgcatagttttttgttttgtcacggtcggagtgcataaaatatgattatttaggtatgtctgcggagtagaggaaaggtgattattacagtgaggagtaacaataaaaagaggaaactaccctggacggagtattccctctttccattcttgaagaaaccattatttatttcttaagaaacgattctttcattctggcaatatcagtcagataatcctgtaagtcctgttcatgctcttcttcttcagccaggatatgtttggcgatgtcacatgtggtgtaatctttaccgtttgtaaagttggcaatctcctgataacggagaatggcgcaacgctctgaagaaacgttttggttcagtaggctgacagagtcgaatgctgttggagagtcgtatttgcagcgggccaattcaaaccattttttcggatcaagcacaggaacaccttccaattcgatgattcggtctgctatcaattgtgcgtggtgacgttcttcttcagcatgttcttcgaactcaccttgtacgtctgcgcgcatagcaccttccactaccaatgcacctacccaatattgatagtatgccaaccattcttcagataatgcagcattcagctgatcaatcaaactttttacatcgagctttccttgcaggatttttacactttctttagccataattcttttggtttaggttataaaaattaagttggttaagtaacatggggcaggggattttgtttcctgaaagggtgattttaacaggaagacatttgctttagggatatttgaagacgtgctttctttttatgtccgattcttaatctatgatccaatctttgatactttctttctttaacttgtgcctgtcctgctattctcttgtcttttgtaattgcactcctcccgcttccgctccaaaccttacttttgaaaatccgctgcacccatacttgttctaatcgcaactatccctttcggcccactacttatctctttttctaaaaaataaccccttgtctctctattgtattcattctcaatccttttctctctttcgtttcttctcctcccgtcacttgatttaacagggagttaaatcaagccttttgtcttcaaataacaagtcttttcgaagcaaaagctttgttatttccgcccctgaaataaatatctccccaaccgcattaacaatgttaacgtttggattccgttcaattcccattcaattcccgtcaaaatcccgtcgtattttctgtttaactcccgtttaaattccgtcaagctcccgttaaatcccctatttttctccgcaattccaccccaaaacactcgttctcctccctttcgtagagtccagtcctgtccgaggtcggttatgacacgcccatattcaggaatgacatgcttacgcggaataagcttcacatccgaataacagatgcagccgtcgccgtcagtgcaaaggtcgcccaattcgatgagcgaatgtccccagtagatggaatcgagcgcatatcgcatgagctgtttgaaccaggattggtcgaagaagtgtaccgcctcctcgttctcatcccctttcacgtctacgattttgaaagagcgtgccatgacaaaccctctgcgctgctccacgcatccggagaggtgaagatctatttccgcgtcccggtagatgtcgtacaggcgctggcggctggggctgtccacattgatggccgactgccaggcatcgcgccagttcttgatgtccttccgggtgagtgcatcggtggtgcgctgcaggtcgatgaccattttctgcacccgcttgatgtctttccccttggccagattaaaattgccgtatggcgtttgcagtacgtttttcggtttactggaaaacataccgctgaaaaagtctttaatatccatagtcctaccaattatgatgaagctgcttctgacagctgtaaacaagtgaatttccggacggaagcccatcttctccgacagccaagggcaaatcagggacaatttttccggcctgtacgccttcaagccacttgatggcccgttcatatcgttccttgcgtatctcgcttcccatcttttgtggcatggctgcgctcatgtggtaaagtgaaatgtcgcaggtgtacatgacaatgagccggttccggtgttcatcctgtgcagagaaaatggccgtacagtcgtatttcggccgtagataaccggcaatttcttcccgggcttccgcttctgcattggtacggttttccgggcttacctgggagatgaccttcaatgcgttgtcgccgatgacaactttgtaatcttcttctgtaatgaacatgaccttattatttagtgatgaataatgccattttttctatatcccggatagtggttcccttgcggaaacggtggcggtgaatcagttcgcagatattctttttggggacaactttcagtttgccgcccatatacaggacgtagtattttcttccgtagagcttggcatacttgcaagcacgggcaacggcacgtttatagcgccatgcaaaaatcattcttttaatcagttgtatcatgttaccatatatttttggcggtcggccttttgccgaacaccggttgaaaactctcctgtcttgaattgcgctgcagcatccagatggctccctcgtcggcatccggtgcatcatcgtgaatacggctgccacgctccagagccaaggtctgttcgattccggtctgcatatccggcgattctttcaacttttcattgtagaatacgaaaccgcgttcccataatggtgacaccgcttcgatgcgctggagcttgtccggcttctttcgtttgtccggcatgatgggcagttggtatccacgcagatttccttctgcctcaaactcatccagaatgacatcctgcatgaagttcgcttccataaagaactggacggctgccgtatcgcgtgtacgctcgtagaggtcgtaaagccaccgtaccattccggaaacggtatcctgccggacgtaacagtctataaggtgcagttccttcccaatcttgccccaaaggcggcaagccttgtagtcgtttgaagtggtcgatttgaaagaggggtcggtatagcagaccagcatttcatacttggacagtctgggcagtttcttgtaacgaatccagtctgcccggaagatagtgccgtccacgatggggttgtgcatcatctccttttcccatgcccggtagcctacgaaatccctgtattcctgcgcctcctctttcgtccatttttcgcgccataccggttctccgttcttgtctattgccttgatgacggatacatgtaccccttttgtcttggtgagattggccagcaccgagtttttagaaatgaggttcccgaccatgataaagcgtccccggcccacatccagtgcaccaaaaagggcttctttcacccagtctgtaatgtcatgcacccgtttctcattgcggcacagttcgtcgtcatccaagtcatcgatgacgatgtagtccgggcgtgcttcccggtcgcgcagaccacgcggagactgtccgcgtccgcaagccaggaatttcaccccgttggcagccttgaactccccatcctgccaggaggcattcccctgctgcttgccgaagtcggcaatgatgcgctggttgtgttccagttccgcctgaatatcgcccagcagacgtgtggcagagtcttcgcttttgccgaccaccaccatgaaattgatgagccgctttggttggaacatgagccataatgggacgaagatgtccatgtgagtggacttggcatgaccgcgcggccacatgaataccgccttcaggttgggcgtaccccttactttggccgctgccgcattgtggaacggtgcattgtgaatggtgcgtatggcttccccggtagtcttgtcacgcaaggtgaggaagtggggaaagtaatattcgcagaatgcggcatagttaccctgcagccgcagaatgcgcctgtccctttgtgccggtgtctcgcctgcgagcagcgccgtatccgtaatggactgtacccttttgcagtgttctttccactgttcgtatgcctgtttcttttccgctgctgttgccatgcccttgttattttatgcccatctgttcggttatgtacaggtcctggtacttgttgatggcctttaccaattccggggtcacatccgggtcgatcgtcgagcggtattcgatccatttggaaaatgccatgaacacttcgatggcatccaccacattggccttcttgtcgagcttctcgatgaccgccgacagttttgccagcttgtcgcccagcccggctatcaatgtggggtcatccgacgagttcacttgtgtgataagcgtgtcgatggtgagcagaagcttgttcaccagttccgggcgagtgacgttctttgccgcccttgcttctttccacccttcggaggtacaccatttggatatggtgacacgagacacgtccaccttttccgctatttccgtttgctccattccggagaggaatagtgagcgtgcgagcgatttcttcttttcgatttctgcctttgtcatattataaagaatataggtttgaacggcaggtattggaatgactgtacacctgcccgatttgttcgcaaagttgtccgcttatcggtttgccgccaaaataatgtgtaacggtttcatagaagtgtgcaaccgttgcacacatttttggcggccctgcgagtgctccgtaatattgcagagccaacgcacaaaggcgtggcatggaaaaatgagtaaacgtgtaagaatttcaaatgacagcctgaacagttacggaagccgcgtgctgacatcgggcatgagtgtggagcagtactgccggaatccggtactgctgtacatgcaccagcgcggtagcgtgatcggttatgtgaaggatatccgggtggaagacggcgaggtgaccggtgaacccgtgtttgacgaggcgaccgacctcagtaagaggtgtaagaaacaatttgagttcggcagcctgagaatggtaagtgccggcatagatatcctggaactgagcgaacagcccgaacatctactgccgggacagacttgtccgaccgtgaccaagagtaaactgtacgaggtctctctggtggacgttggttctaacgatgatgccatcatattgatgaaagacggtaaacaaatcactttgggaagggacggggaatgtcccttgccatcaatcaataatcaaaaaacagaagaagaaatggaactgaaacttttggcccttcaattggggctgccggaaacggcgacggaggctgatgtaacccgggcattgaatgacctgaaagcggccaaggctgagaatgactctctgaaagatgaaaacgggaagctgaccctggcccgcattaccggtcttgtggaaaaggccgtagcggagaaacgactgggggaagacaagaaggcacagtttatcgaactgggcaagaaggttggatccgacgagctgaagaatgtgcttgatgccatgcaaccccaggtgaagatctccaccgtgctgagttaccagggtggcaagcagcaggcacagccgtccacctatgccaagctgagcgatgtcccgagtgacgcactgcttgaaatgcgtgagcagaacccggaggagtacaagcgtctgtacaaggccgaatatggaatgacctgtgaaatttgaaaacctttaaaatgaagacaatgggaaaaattgtaatgcttttgacggcactcctgttcaatacgctgacaggtgccgtgtgtgcttccgtgctgggattctctcctgcagccggagctgtgggaatgaatgcggtggcagccttcatgggcatggctccgcagagcgcttcaatactccgtgaaggggtttatacggaaatctggacgggcgagcttgtcaaggtactccgtgccgggctggaaggcacgtggctgtcaggaattcccgaccaaagcagtatcgtgaacaacgatgtgattcatctggtagaggtaggggtggatccggacgtcttgattaacaacaagacctacccgattgacgtacaggctttggaagacaaggacatcgccatcaagcttgacaaattccagaccaaggccacgccgattacggatgacgaactttatgccatcagctatgacaagaccgcccgtgtaaaggaaggtcatgccaacagtatcaatgatgcgaagttcaccaaggcggcccatgccctttgcgcgaacaagaatacggcaacgaccccggtgcttaagactaccggcgagaaagatccggccacaaaccgtctgcgccttaccgtgaatgaccttgtggaaatgaagcgtgcccttgacaacctgcgcgtgccgtcagacggccgcagactggtgctttgccccgaccatgtgaatgacctgctgctgaccagccagacattccgcgagcagtacaacattgaccgcaacagcggcaaggtaggcaacctgtacggctttgaaatctatgagtacggcaacaatccgctttatactacagccggagtgaaaaaggcattgggtgcaacggcagaagccggtgaattcccgtgttcgtttgccttctacaaacagcgggttttcaaggcaacaggctctaccaagatgtattattccgagtcaaagaacgacccgttgaaccagcgtaacctgattaacttccgccattacttcatctgcatgcccaagaaagaggatgccggagtggtaatgatgagcggctatcaagcatgatgattatggcaaagttgaaatatctggtaatacactgtacggcaactccggagggacgtgaggtttcatctgcggacatccgcaaatggcatacatctccggttgcccagggaggaagaggatggaagcaggttggctataccgacctgttccacctgaacggaggcgtggaacgtctggtagaaaacaatgaggatgcacaggtggacccttgggaagtgaccaacggagccaagggatataacagtgtgagccgtcacatcgtgtatgccggaggcgtggaaaaagacggtaagaccccgaaagacacccgcaccggctgtcagaaaaaggcactggagaagtatgtgaaggattttcaccggaaatttcctgatgtacgcattgttggacacaacgaactggcagcgaaagcctgtccgagtttcgatgtgcaggaatggttgaaagaaataggtattaatcaataataaaaccgggtggtatggacttgagcgaatttatgaacattatccttggcggcggcctggttggtacggtggcgaccattggctccttgcgggctactgtgagaaaagcgaaagcggaagcgatgaaggccgaggccggtgcagaggctatgcgcatagataacgccgaacatgccacccgcattttgatggagaatattgtaaaacctctgaaagatgaattttgtgaaacaaagaaagaactggcccgcaatacacgtgagatggcccgtcttagaaaagctattgatacagccgggaactgtcctcatcgtgacgattgccctgtgcttgacaggttgcgcgagtcaccgaaagagcatgaaccgggaagtccggacggaaacggcaagcgccgacagcgcgagcggaagtcgacgggcgggactggtgatggcgggggtaccggcgagttcggtgaagctgactataccggcggacagcctccgtaaacttcctgaaggggcggtgtatcgcgggaagagtggacaggcgaatctgaccgtaggcagcgacgacagcgggaacatcgtggccgaaggtcccgccgtaacaatgaagtttaccgcttgaccaccacattgtataattccggtatcaaaggttctacggttgaagagcaggcctctgtctgtctcgctcttctgatgggctacaacgcatcgttcatcgaccacggagaaaagcgcgaacatatccagaaaatattagatcgttgctgggatatcctcggtacccttcccgcttcgctattgaagctccgcctgcttactgcctgctatggtgaggtattcgacgagcctttggctgacgaagcccgtgcaattatcgcttcttgggattcggtatcacttactactgaacagcaagaggctatcaatgagtttcagactgtggtggataatccttatccgtgggagtatgtttaaaaaatattttattattatgcttaataacaaatctgtcttgattacagggggaacaggttccttcggtaagaagtttgtggaaactattctgagtgattatccgcaagtaaaaaaaatcattatttattctcgtgatgaactaaaacagtttgaactaaagcagaagtatccggagaataagtatcctcagatgagatatttcattggtgatgtacgcgacctcgaacgtctgacccgtgcttgtgaaggggtggatgtaattatccatgccgctgctatcaaacaggtagatacagctgagtataatcctgaagaatgtatcaagaccaacgtacatggtgcacaaaacgttatcaaagcagctttagcagcaggtgttcatcatgtggtggctctatccacagacaaggcttgtgctcctatcaatctttacggtgcaaccaaattgacatctgataaattgtttacggcagccaataatatcagtggatccaaagatatcaagttttctgtggtccgttatggtaatgtgatggggtctcgtggttccgtcattcctttctttatcaataagcgtgataatggagcgaaggaacttcctattactgatatgcggatgacccgtttcaatatctcgctggaagctggtgtcgctttggttatgtatgccatcggtcatcatttgggaggggaaattttcatcccgaaaattccatcctatcatatcaaggatgttgctactgccatcgctcccaatttaccgcaggtagaagtaggcatacgtccgggagagaagctacacgaggagatgattaccgtgaccgatgctattgatactattgatttgggtagatattatgtgattcttccttccgtatcagataagcataatagggaagaatatattcaacaccataatgctgtggttgtacctgaaggtttccattatagttctgacaaaaatactgaatgggaaactgtggagtctatgcgtgaaaacatacgtaaatttgtagatccaaattttaaagtaaaatgaaagttgtagctatcattcaggcacgttgtgcttctactcgttttcctaataaagtatttgcggatttatgtggtaaaccatttatttggcatgtggtaaatcggttgaagtttgtacaaacacttgaccatattacattagcaacgacagatagaccgtcggatgataaattgtataattgggctaaagaaaatggagtggatgtttatcgtggaaacgagagtaatgtgctaaatcgttattatgaagctgccgtttattcaaaagcggatgtaattgttagaataacggctgatgatccctttaaagaaccggtcttgattgatgaggcagtgaatgcgttacaaaaaggaggatatgatttcgtttgtaataactgccctccctcttatccagaagggttggatatagaagtactcaccaagacagctttggaaaaagaggagaaactttctacaagtgactttgaaagggaacatgtgactcagtatatttatcatcatccagaagactttaaaatattcaatctttctaatgttggggagaatctgtcctatttgcgttggacagttgatacggaaaaagatttccagatggtaactcgcatatattcatccttgtacaaaaatgattcagagatatttcacatgaatgatattcttcagttacttagagaacatcccgaaatagggaggatgaattctgatgtggctcgaagcgaaatgtataaatcagtataattatggaaagaatcagtcaattagaacgtgattatgtgaatcaggttctggataatgcttttgctacttcattgaattctgtattcaacaacagattggaagccgcttttgctaaaaaatttaatcaggcttatgccattggacattgtaacggtactgctaccttgcatacggcagtggcagctttaggccttaagtctggtgatgaagtggtggtgcctgctttgactatgactagtacttcttttggagtattgcataacggatcaatacctgtgtttgcagacagcgatttggatacgtttgagatttctgctgaaagtatagaaaaggtaatcactcctaaaactaaggctgttatgacagtctctctttttggcttggctccagactatgataagattctggatatatgtaaacgttataatttgtatcttattgaagataatgcggaatgttatttagggaagtataagggcaaatatgtcggtgaatttggcgacttttctagctttagttttcaggcgagtaaacatttgactgctggtgagggtggtatgctcttatgtaacaaagaggaattagcggacaacgcccgccgttttaattgtttagggtatgctggtgtaagtgctagacaaggaaaaatcacaagaaatgatattcaagatccccagtatagccgacacatttcattgggattcaattaccgcatgtcagaattacaggcggcctgcgctctaggacagttggaacgtgtggatgaactggtcggtaaacgtattgaagtggcgaggatatttgatgaagccattaaaaatcagcagttgctgaaaaggcaagcagagccggaagggtatgtaaattcatattggtcatatagcatggtgctagatactgattgtccggaaaaggactggtatgcttttcgtgacttgtttcaagcaaatggaggtgatggttattacgcagcttggaaactttcgtacaatgaacctttgtttcaaaacgagatacagtatatgcctggagtttggcaaaagtatgatgccaatctttgtcctaatgcggaatatttacagaaacgtatggtgcagttgaaaactaactattggaatttggatgaagctaaaaaacaagcggaagttcttcataaaactattgagcaatttacaaggtaaaaattatgggattttttaataaagagataaagattggaaataagattataggtgatactcatcccacttatttcatcgcagaaataggagcgaattttgacggaagtattgaaaaagctaaacacttgattgatgcggctaaggaagcaggagctgattgtgcaaagttccaaactttttccactcctcgtattgtgtctgagggcggtttttcccatatgcagttgaaaggcgtgcacggttcctggggacgtactgtcagtgaggtgtttaaggatgcggagttccctgtagcgtggcacaaggaaatagcggactattgtaaggttgtgggtattgacttttccacctctccttattttaaggaggcagttgatttgtgtgttgatttggatgtaccttttatcaagatcggttcaggagatatcacttggctcgaaatgctggattatattacccgtaaaggaaaacctgtaatgttagctacgggtgatgccaccatgtctgaaatagatgaagctgtccgtacgattgaggctacaggaaataaggatctggtactgatgcaatgcataaccaattatccgtccaaaatagaaagtgccaatgtcaatgttttgaaaacttatcagtctgcttttgatgttttgacaggctattcggatcatgcacccggacatgtggtcgctttggcatctgtagttatcggcggtcgtgtcattgaaaagcattttactttaaacaagactgacaagggaccagatcatccgcattcgatggaacctcaggagtttagatttatggttgattccattcgtgaggtagaacgcgctatgggaagtacccgtaaagaggtagttgccgaggaaggagagacggtatatgtccaacgtcgttgtttatatgcaaaacaggatcttaaaaagggacatataatgacttctgaagatatagatatacttcgtcccgctttaggtatacccccaaaattcaaaccgatgattattgggaaagagtgtaaagaggacatagtaaaaggtcaaccgttgttttggaataacttctgatgatgaccgaacgtgaaagatttatagcagttgtcgataatgatattttaagatcttccgatgcaattattttattggaaggagacggtttaaatcgttatcggaaagcaatagaactttataatcagaatgttgccaccaaaatagtatttagtggtaatattactgattatgaatacggaagtttccctttctcggatgtattgccttatatattaaaggaaggtattcctatggatgttgttatacatgaagacaaatcattgaatacaagagaacaggctgttgaagtggtacgaatggcgataacaaatcggtggaaacggttggtcctagttgctagtcatgagcatcagtatcgtgcctatctgacatttttgcgtgaggtgttggataagaagagtggtattatcctttacaatgctcctgtaaggaatttagggtggttcaaaaaaacagagtggggtgtacggtttgaacgtttggaacaagaatttgtccgtattgaaaaatattttcaattaggtcatttggctacatatggagaagcgatagattatcaaagatggaaagaattacaatagagcaggcgcaagaactgtttggcccaaatttcataggatgggatgaattgaaacctctttttgaaaggatggaacttccgttatcttccattcaaattccggatgtacactactcattggatgatttgaaaaattgttcaaaacattatattctaatattaggtattcctgaattaggtgataaaaaactctccattgctaattttcgtagatgttttggaatgaatcccgatatttcagaaccctgtttttataatcaggactggtatatgaatgaaaagtttattcatgatactttggatctacgctggtatttattgaagaaagatgctattgagagttctcgtgcagttcaaccttcagagttactgaaagaacgtataaactttccaagggcaatcttgtgtgtctatactttttttgcttattaccatgtccgcaaggaactgttgtggtatcatgattttatttggtgtcatgatatagatcataatggtgatcgtatttatataggaaaatatcatgatgtggacggggtgaataaaaatggctttagtattcatcggcatttggctttaaggaactgttatgcagcaatagaacaaatttaatagtaaacccatatagaatttggtcaacattcattgtatgactgttagcgtcctattttgacgtattgctaagatactaataaaatcagacttttgctcttgttaactcaaaagcaaagtttatgtatagttacaatgattttgaacgtctttttgtgcgttataaataggaaggcgttccctctggaatttcgatagagaaatttagtttgtccaataaggttccttataacttatttgaagaatgctacaaggatacccagagcaagataatacctgtctaagtcttgggtgtcttccaacggatgtggattcggtgaaaacatctgcgccaagtgtgaattaaaagccgatagtcgaagccccccgttcttccgaatgctgggctttgtatattggtggatatccgtatgagcaacagtgtgtatatcagtcagaaaaatttaagctacgcaggtttgaaaaatctggtagagaaattggagggcttatggtgaatataacaggtttaaagtctcttttgaagtcccatctcatcatctcaacatgtaagatgcagggtgtgtcagtgctggattatttcaagagattcttcagcaagattgttaaaggtcgtaggggctatgagcatttattgcccttgactatcggagtgaactaataacaaattttaaaaattaatatcctttttgacgttatttattagggaaccgctttgtggcggctttttgggggatacatgtcaaaattggacgctaacgcaaattatgtataaagacgtattgaaatatagcatttttggaatattgtatcacaagttccacgccgtgaactgctcggcctccagtacggggtacttccaatcacgctggaaccccgctgcccggtggttgaacatcatgccggcataggccgtcacaccttccccggctttcagcagggtcaggtagtgtatctcgctcaccacgccggagttctcgtgcagcgcataggcttccaccacgttcatgccctcccgcatttcgctcaacgcaacggtgacgttcttctgctggacaccggaaccggctgacaggccaagcgtatagggctgcccgccgttgatacggtagtagatgttcttctcgccactcgttcccttagctgtaaatgggatgttcacgtcgttccggtatcccccgtcagccagtccgttcccaaccgaataagtggtacttagttccatagccaccatcgtcaccctggcggtagcggttttcatcagcgtaccgccatcataaccggtctgcgcctccacctgcacggtgtaggtcgtggcatccttcaggtaaggcgacgcgtcaaaagtatagctctgagcggccgtaacgccgacaaactccgcatcctggaattccgaaaggaccgtggagccacgttttacgaccaccttggccttcaggtcgctgtagccactcacctcgccgccaccggccgtgcccacgccaacggcatatctcaccacgaaaccggtacccaacgacaaatactgggaagcgggcaaggaggaacccgatgcgtcggtcaggtctatattcaccaccaccttgtcatcgtcgctatacttggaaaagcgcaccaccctgtcgctttccccgccttcgccatccttctgcgtgactgtcatcacgtactgagtgccgtcctcgctgtccgtcacgtcgatattcgtcacggtgcccaccagcgaggcgaacaccgcgccgctcgtgggggctttcgtctcaccggcggccagctcctccgtaggggtggccttgtcatcaatacttttgatatagttctccaccaaccggccgctcaccggaagattacccgtggattcgtcaccggaccaatcggtcttctgcatatccagaccgtcctcgtcatatactttctttgccatatcgttattctttaaaagttatttcatccgtttccagccatccgttcggctccaaggtttgtcaccgcgccaaaagcccgcgccgaaacagctccggatggcttgccaaaccagcctggaccctatatagaccgtcgccaccacccgttcgcctacacggatggccgtcacctccttgtttccaacacttatcatacctattcctcctcgtaaatcaggtaaatggtcttgccgtccttttccgggagacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcgttatacacgtatgtaccgtcggaattgcggctcttgatgtaccggaaccctttcgacgcacaaacatcacttgtcaatccgctaccggtatcccttacatctaccggacccacaaagaacccggcataggtcataccgctggccgggtaggttaaggagcctatcgatgcgtatatagcggccccaccggatgtcgccccgactgattttacgccaaaccgcccactggtagcgccattgaaggccacgtccacgatcccctccgtcgaggaactcgagactcccagtttcaaactccgggaatcgtttccgaaataatcgcggctcttccaatacagacggccggaatcgatggtaaagccgccaatcttaccgccgctcgccttgacagtaccgctgatgttcgcattccgggtctcgatactcccgtccgtgaggaccttgaaatagccgttagccgtaacaagcccctccagtttgatttggtcggctttaatggtaacaccggaaacaagattgccgaactcgtcacgcttgacatagacattcagttccgccttctttacaagcccgttgcttgtaacgccctcagcgaacagcttggaaaaattggcggtagtcaccaacccggatttattccgcaattccccgttctcatcgaaatggacagaaatcagcctgttatatttggccgtcgtgataatggaggatgcctccagcacattgccgtccttatcgaaattcgccgccgcgattcggatcatcttatccgactggtcaaagaacgtggcatacttgtacgccaaggcatccgtccggtcggtcgagaacaccaacaaggacacttggataatacccgtgaacgacagcttgaagtcgccggtcccgttccactgcccggaatggttgaataccttttccccaccgaccggcaaatcaccgtcgtaagcgaacatgttgaaattctcgtatccgctcttgttggaattgacaaactcgatacgcaggtgcccggcttcgatcaccttgtaatggaaggacaggtagacatagcccgggatacgaagcccgtccccgttcaactccttaaaatcggggatcgtgcgaaaatccccgttcttctgcatgatatagctgttcgttatcctgacgtaagggaccttgccggtctttacgacctccacgtttccgttctcgctcgatgctaacagtttgttaccggcaagaatccacttgccgccgaaagtcaggaacgcggccttgtacccgcttatccatttactcatcccctcggtaaacgtggtgttatcgaaaaagctctgctcctccctcacctcgtcacgcagaccttctacggcggactgtatcttaccctccgtaatttcaaatttcgtcaggatatcctcgccggtcataaggatgaacgtacctttcagatatacgttgtcgccatagagaccgttcccgtgcggctggttattcgccggaaaagcgctgtccttgataccgtcaagattacccacccggcatctcaaacagccgttgaagtttttcgccatcacgccatccagtatgtcaacacgcggctggccgtcctcggtagccgatatgctgatcaggttctgccggagcgggttttccgtgttgcccatcaacacgcactcatcacccgccttcggttccgtcccgccaaactccctctggggtaccgttatcccttccgcgtcgccttccgacacttccacccagtaaccccgaatctctgcccccgtaaaaacggcacagcgcatcaggtcatgcgccacgaacgtgttctcttgctcaaaggtgatgcggtaattgttgccctccttggtcacggtcttgatcttgccgttggccgcggatacaaccaactgcccccttacgctgcgaaccgtttctatgagcaactccagggccaccaacgtctgccggatggtcgccttgtctatcgtaagattactcagccccgttattttatctatccatagctgccagccctcgccgaacataccgtccacgaaacgggtactgcggagcagttcacggatgacagccgtcagaaactcggcgttcccgtcgccgtcaatattgcccccggattcaccggctttgtaatccccaaaataagtccctttcaggaaaccgatcacctcggccgcggtatcccgatgacgtttgctcaggaactccctctggcttcttttcgccgagaaaaggttgttgtccgtgggcagcgtattatcgaagctccggataatatcgggaagcccggaactttcggccttggctttcgtatagctttttagttcccctatgctgtcgtttaccctgtcgaatttcgatacctgcagggcgtcgctgatctccaggtccatctccccgggaaggttcaccttacgcgtgatcttcgtaatgcggctcctgcggtaaccgtctttcgggaaatactcggcactctccaattttacgcgccggccgacaaacagatcggcctcctgccgctcgatccacacatggtcggtcggagccttgtaagccgcgatatccagccagtggtccttgttgtattcgtccaccgcggccgcaaattcctcctctgccagccggtaatacttatccggcatccggatgttccaaaggacataggtgtccccggccttcgggacgagcttgccgcccggaagctgcgtatcatcaccgtaaggccagatcgtgatgatctcaaactcacgggtggcgctatcgaagttcacctcgaaataatggtcgtccccctctcccagcccggaaaggtcaccgctctggaaggagacgcgtttcgtctcaccggccagctcataatcgttcggatcgaaatccatcccgccgtccttgaagtaatagacggtaaaggccttaccctcctcgtccgtcacctcctcactgcggacactgcttaccgtacccacccgccggggatagataccgctgaaggcggcctgttcgtagtggtcatagataccgtactcgtccacgcccacctccacgtacttcttttttccggggagcatcagacgggggctgccgtacttctcggcgtcgatgttccggctgctgccgatcgggaaaaggcgcgtgtagaactttgccgtattgctcgtatcccgctccagggaggtcagccccttgccgtatcccaacgtgatctcctcgccgtgttcgcaacggcacacgttcaccgtctgcccctcgacccaccactctgccttgcctcccaccttgccggcgatctccttcaaggcctggtcgcagtacatgccctcgtagtcgatcacgataaggtcggtaccgtccacctgccccaccttccagtcggtaatgttacccatgccgtcgttgatggccttcaccaccatcgccacatggtcacggggcgtggccgtcaatgtaaacaggggattggtgtcgccgtccgttgtctccagcacgagaaaacgcctgatcaggctctcgataccgtacagcttcaggttatactcccactcgctaccgcttttctctttcggggtgtaccgctccgtcagccagtaccgctcgcccatgtagtccgtgaagtcgcctacatcaagggggatatgggcataatgcgtgaaggagagcgccagcacgttgtcaccctgcacctccttgctctgcgtcgaactgtcacttgcggccacatccgcacgcttggccccggctttatcgtatatcgttaaaagcatattcgaatcgtctttgaatagttatataatcggtaccggctcgcggaacttcaccttgaatttcccggcgtggaccccttccttccacaaataggtcagcggggtgaacttcgggctgtccgtgtataaacattttaaaaaaaaacttcccaaaacatttggtgttttaaaataaaccttttacctttgcacccgcttttgaaacgaagcgcaatcgaaaagaagcgttctttgaaaaattgataaacaatacaagtagtacaagtaaatttagaaccgtcaatacttattatataggtatatgaaaaaatgaccgtcaataaattttcgacatcctgaacagagctaatattatcccttacgggatatataacaatacttttacaatgaagagtttgatcctggctcaggatgaacgctagctacaggcttaacacatgcaagtcgaggggcatcaggaagaaagcttgctttctttgctggcgaccggcgcacgggtgagtaacacgtatccaacctgccctttactcggggatagcctttcgaaagaaagattaatacccgatgggataatcattccgcatggtttgattattaaaggattccggtaaaggatggggatgcgttccattaggttgttggtgaggtaacggcccaccaagccttcgatggataggggttctgagaggaaggtcccccacattggaactgagacacggtccaaactcctacgggaggcagcagtgaggaatattggtcaatgggcgcgagcctgaaccagccaagtagcgtgaaggatgactgccctatgggttgtaaacttcttttatattagaataaagtgcagtatgtatactgttttgtatgtataatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgatgtggaaacatgtcagtgagcaatcaccgctgtgaaggtgctgcatggttgtcgtcagctcgtgccgtgaggtgtcggcttaagtgccataacgagcgcaacccttatctttagttactaacaggtcatgctgaggactctggagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaaggagcgtcctagggtaaaactggtgactggggctaagtcgtaacaaggtagccgtaccggaaggtgcggctggaacacctcctttctggagcgatgttgaaaacgacgttcatcggttctaaaattgtactactggtacttgtttatttatagaatatagatcgaccgtctatagcaatatagatagagataaacaagagaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtcctatagctcagttggttagagcgctacactgataatgtagaggtcggcagttcaactctgcctgggactaccaagacgagattgatatcttgtatgattgggggattagctcagctggctagagcatctgccttgcacgcagagggtcaacggttcgaatccgttattctccaccattgatacgctggcaacacaagttgccgaatgttatcatacgatctttgacatgatgtacagaaaaaagtaaatttagtaagagctaaaagtatatatcgaaccatttggttcagatcctttttaagaaaaggagatgaacctggcgataaaagaaagtaaataagggcgcatggcggatgccttggctctcggaggcgatgaaggacgtgataagctgcgataagcttcgggtaggtgcaaataacctttgatccgaagatttccgaatgggacaacccggcattctgaaggaatgtcatccaaccaagttggaggctaacgcagggaactgaaacatcttagtacctgcaggaaaagaaaataaataatgattcccctagtagtggcgagcgaacggggaatagcccaaaccacccatgttacggcatgtgtggggttgtaggaccacgctctcgcaagaaagttattgagaagaagcgactggaaagccgcgccatagacggtgatagcccggtattctaaggtaactgaagcgtagtggtatcctgagtagcgcggagcacgaggaattctgcgtgaaccagccgggaccatccggtaaggctaaatactcccgagagaccgatagcgaaccagtactgtgaaggaaaggtgaaaagcacttcgaatagaagagtgaaatagtccctgaaaccatgcgcctacaagcggtcggagcagcttatgctgtgacggcgtgccttttgcataatgaacctacgagttactttttccggcaaggttaagcatcttgagatgtggatccgaagcgaaagcgagtctgaacagggcggatagtcggaaggagtagacgcgaaaccaagtgatctacccttgggcaggttgaaggttaggtaacactaactggaggaccgaaccgataagcgttgaaaagcttccggatgacctgagggtgggggtgaaaggctaatcaaacttggagatagctcgtactccccgaaatgcatttaggtgcagccttgagaattactaatgtgaggtagagcgactgataagatgcgagggcttcaccgcctatcaagtcttgataaactccgaatgcgcattagttcgatctcaggagtgagggcatgggtgctaaggtccatgtcctaaaggagaagaatccagaccatcagctaaggtccccaaataaacactaagttgaactaacgaagtcagattgctaagacagctaggatgttggcttggaagcagccattcatttaaagagtgcgtaacagctcactagtcgaggagtttggcgtggataataatcgggcattaagtgttttaccgaagctatgggatacgtaagtatcggtaggggagcattccactctgcgttgaaggcgaagcgtgagctttactggagcgtgtggaaaagcaaatgtaggtataagtaacgataaagggggtgagaaaccccctcgccgcaagactaaggtttcctgatcaacgctaatcggatcagggttagtcgggtcctaaggctcagccgaacggtgatgccgatggcagaacaggttaatattcctgtactagcattaagagtgacgtggagacggaggagtgacaacgccgcggactgacggaatagtccgttaaagggtgtagatgttgattgtcccaggcaaatccgggataagagtcgaacctgacagtataccaatttcctcggaaaacggtaatagtgcgtgtaaacatactcccaagaaaatccgctaaacttaatcttaatggtacccgtaccgcaaacggacacacgtagtcgggttgaatatactcaggcgcttgagtgaatcacggttaaggaactaggcaaattgaccctgtaacttcgggataaagggtccctacccggtgacgggagggcgcagagaataggtccaggcaactgtttaacaaaaacacagggctgtgcaaaattgaaagatcacgtatacagcctgacacctgcccggtgctggaaggttaagaggagatgtcatcgcaagagaagcattgaattgaagccccagtaaacggcggccgtaactataacggtcctaaggtagcgaaattccttgtcgggtaagttccgacctgcacgaatggtgtaatgatctggacactgtctcaaccgtgagctcagtgaaattgtagtatcggtgaagatgccgattacccgcgatgggacgaaaagaccccgtgaacctttactatagcttaacattgaatttgggtaattgatgtgtaggataggccggagactttgaagcaggtacgccagtatttgtggagtcgctgttgaaatacggccctttgattatttgagttctaactcgcagtcgcgaggacactgtttggtgggtagtttgactggggtggtcgcctccaaaagtgtaacggaggcttctaaaggtgccctcacgccgattggtaaccggcggcagagtgtaatggcataagggcgcttgactgggagacttacaagtcgatcaggtaggaaactagagcatagtgatccggtgtttccgtatggaagggacatcgctcaaaggataaaaggtactccggggataacaggctgatccctcccaagagctcatatcgacggaggggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgcatgaaatttgcgtggctctgacactagtacgagaggaccgtgttggactgacctctggtttaccggttgtgccgccaggtgcattgccgggtatctaagtcgggattggataagtgctgaaagcatctaagtacgaagccagccacaagattagatttcttttagggtcgttgtagactacaacgttgataggacgcaggtgtacaggtggtaacatcacagccgagcgttactaattgcccgatgactttcttttattgtcttttatggtttatatatccgtttagctttactatccgggtgatagacggctaagtttacttttgtacattatgtctgccttattcaggtgactatagcatcagggttccacctcttcccattccgaacagagaagttaagcctgatcacgccgatggtactgcgtaacagtgggagagtaggtagtcgccgtttttttcagagagttcatcccctcgggtcagaagacacgaggggatgaattttatttgccagcaaatgaaatctaaacaaaaagccacataattaaaagtttttaataaaaacttttaattatgtggcgcaggcaacagatttttaagcaatatttaactaaaatattgatagttgaaggttaactatgtccaaatttaaaatgaacatattatttcctttatatatgggtaattagcataataaaaaaacaggcacaccataaaagatgcacctgtttcaattttagttatttagcagcaccaatcattgcaagcattgcgcctgcagctactgcggtaccgataacaccagctacgttcgggcccatagcatgcatgagcaggaagttagcagggttagctttttgaccaacaatttgggatacacgtgctgccatcggaactgcggatacaccagcggaaccgataagaggattggttttaccaccatccagaacacacatgattttaccaaagataacgcctgcaaaagtaccagctgcgaaagcaacaagaccaaggcagatgatcaagatggtttgatagttcaggaaagattcagctttcatagtcaaacctgtaccagttgccagcatgatcgttacaatgttcatcaaagcattttgtgcagtatcggaaagacgatccaaacaaccagcttctttgaacaggttacccaacatcagcataccaatcaaagagcatacaggcggaagcaacaagctgataacgatagtggttgcaatcgggaatacgattttctcaaaacgagttacaggacgcaattgtgccataacaattttacggtcagcttcggtagtgcaaagtttcataataggcggttggatcaaaggaaccaacgacatataagaatatgcagctactgcgatagcacctaacaggttaggagccatttttgcagccaggtaaatagcagtcgggccatcagcgccaccgataataccgatagcggatgcttcttgcacggtaaatccgagcatcatagcgcccagcaaggaaataaatacacctgcttgagctgcagcgcccaaaagcaaagttttcgggtttgcaatcaacggaccaaagtctgtcattgcacctacgcctaagaaaatcaaaggcgggaaaatttcatgattaataccataaagaattacctgcataacacccggttggtcttcgaaaccggttttaggcacgtttgccagcaaacagccgaatgcaatcggagacaacagcaaaggttcaaaacctttaccaatagccaaatataaaagaataatacctaccaacatcatgatggcatgacccatggtgaaagcggagaaaccgctgtcattccatacggattgtaaagcaactacaaatgcttccataatttcctcctacaaattttttagttgagagaccttttcaaggtctctcagcttgtttgtattacattacgatcataacgtcgccggtaccaacagtttgacctgcggaaatacggacgtcagaaatggtgccgtcagccggagccatgatctcgttttgcattttcattgcttcaagaatcatcaatacgtcgccagctttaactgcgtcgccagctttaactttaacttcgagaactttaccaggcataggagcactgatagtagctgcgccagcagcaacaggttttgcagccggagccggtgcagcagcaggagctgcttttggtgctgctgccggtgcagcagcaggagctgctttaggtgcagcagctttaggagcagcaacgccgcccatttcttcaacttctacttcatatgcagtgccgttaacggtaatggtatattttttcatggatgttaatcctccttaaaatctcgtaataaaatagattaattattaaccccannnnnnnnnngtatattttttcacagggcataccctccttcaaaattgtttaaaatatattaaacttaagtgttgctaaaacctaactttgttttagaagcattctttacgtacgctaattgcttcaatacgagcattctgtgtccagccagcttcgggcagacgacgtacataagcgatatcttctgcagaatggccaagagcagctacagctgctgcaataacagcaattacttcactgtcatcctgcacaggagctgcaacagcagcaggtgctgcggcaggtgccggtgctgctactggattagctgtttttttttgacgagtaggatctacaaagtagataactttcatcaagaaacccagcatagccaatacaccaaaaactatggtcatattgatagcagcaatcaaccaaggattagtagttacaggacccattatttcacctcattcttcttaattaattaagcactatactgcaagctgcaaattacaaaggaatattgccatggcgttttgccgggcgagtttcacgtttggactgcaacatttgcaaagcgttgatgatggtgggacgggtgtttttcggctcgattacgatgtctaccatgccgcgcattgctgcttggtacggagttgcaaagttatcgatatattcttccgtttttgcttttacatcaggatcatttttgaagatgatgttagctgcacctgcaggtcccattactgcgatttctgcagtcggccatgcaattacttggtctgcgcccaaatcttgggaacacattgccaggtaggaaccaccgtatgctttacgggttactacagtaattttaggtacagttgcttcggaatatgcatacagcatttttgcgccgtgacggatgataccgccgtattcttggttacagccaggcaggaagccaggtacgtctaccaagttcagcaaaggaatgttgaaagcatcgcagaagcgaataaaacgagaggatttgtcggatgcgttgatatccaggcagccagccattactttaggttggtttgcaatgatacctacggtttgaccatccatacgtgcaaagcaagtgataatattggttgcccaatattgttgggattcatagaattcaccgttgtctacgatggatttgattacgtctttcatatcatatgcttggttggagttatccggaagcaatgtattcaaggagtcatcaatacgcatcgggtcgtcaccggtttctacgataggagcgcattccatgttgttggaaggcaggaagctcagcaggtaacggatctgttgcaagcaatcttcgtcgttttctgcagcaaaatgtgcaacgccggaagtgctgttgtgggtcatagcgccacccagttgttcttgggttacgtcttcaccagtaacagattttactactgcggggccggtaatgaacattttagaagtgttctttaccatgtaaatgaagtcagtcagtgccgggctgtatacagcgccgccagcagaaggacccatgatagcggagatctgaggaactacgccggatgcaatagtgttttcaaagaagattttgccgtaaccagccaaagcgtcaattgcttcttggatacgagcaccgccggaatcgttcaggccaacaagcggagcacccattttcagggacaggcgttgtacttttacgattttagcagcatgcatttcgcctaaagaaccaccttctacagtgaaatcttgtgcgaatacataaaccagacggccatcgatggtgccgtaaccagtagttacaccttcgccaggaagttctttcttctcttggccgaagtttgtgcaacgatgttttacgaaacgatccaattcaacaaaggatccttcgtcgaggagtgcagcaattctttcacgtgcagtcattttgccggcttcgtgttgttttgcaacgcgtttttcgccgcctgcagccagaattacttcggactttttgagcattttctcaatttttgcttgagtagacaaatcttacacctccatcattattgggagaaccttattttatatacatctacgcggatgcagactctttggtccgcatccgtgtagtatgtaacaacttaaaataaaatcttcaaaagatttttgtaattccgtattttacggaattatttttttgccggagcgcaatactcaagcaaaatacctacggatttcggatgaacgaaagcgatatccattccgccagcaccgccacgaggagctttgtcgatcatagcagcacctttttcaatagtggtatcaatagctgcttgaacatcatcaacgcgaacagcgatatgttggataccttgtccatttttagcgatgtatttgccgatagggccatcgccattttcagtgatatcaacaaggagctcaagcaaagtttcgccacagggaataaatacggtttttacaccttgctcaggaacagcttcttcaccagtgcagctcaagccaagaacttcagtgtagaatttcttggaaagatccaggtctttgcaagcaatacctacatggtcaacacaaattgttttaaacatttcaaattcctcctaaaagtaattttggttgttttatcttaaaactttaccaacaatgtcagcgacaacagaatacggctcaatttcacgaatttgaagtttttcaactaaaatatcaaattcggaagtagctacaacattcttgtcgatataacggttgaccctgtcattaagcatagcagtaacttcgtttttaatacgagctttgcgtattttgctcaattgatcagattcaatcaaatatgctttgtgctcttcaatagagtcaacaacagcttctataccttcacccttgctggcaatggtccgattgatcggaggacgccagccaacatgttcgggatttaattccaacatcatttcaatctcaatgttcagcttgtccgtaccttcacggtcagctttattgatcgtgaaaaggtcaccgatctcaagtatacctgctttaatagcctgaatgtcatcgcccataccaggaataacaacaaccattgtagtatcagcagttttaacaatatctacttcagattgaccaacgccaacagtttcaacaataataacatcaaaaccatatgcatccatcaatttaacagcatccacccaaactcccgcgagtagccatggaacgaacaaaaatgccttcatcggcagtaaggtccaacattctgatacggtcgcctaaaattgcaccaccggagaaaggacttgtaggatcaattgcgataataccaactgttttaccgcgtttacgatattctttagcaagcttgtcggtcaaagtacttttgccagcgcccggaggtccggttattccgatgacataagcattaccggtgtggggataaatggctgtcattatttcaacagcgttatcatactcgttctctacggcagtaatagctttcgctaatgctaaacgagaatggtttaatacgccttcaacaatattcaatgatcacaccgccttgttcaggtcaagggtatctcggaaggcgtcaaggcgaactccgacgccggcgtgtcaccgtccgtcaatgccctcaacacgggcgtcaaggcggcagccgccatcggcggccttgccgacggcctgagcgaggccgcgatgctccccgtgctgggtgccatgggcatgaagggcatggcctgcctgcccatctccaagcagctcgacccggtcatcggcgtggacatccacctcgtgacgataccaccttcccccgtcgtgcccatgcctcacccttatgtcggggttctccttcgtccgcaggacttcatcgcggcggcggtctcttcattcatccccccgcctccgacagcggaacagacgggcgacgccgacagcgcgaagctcgccgaggtgggccataccgtgctgacgatggtcgtcgggatgctgggtgccaccgtcaagataggcggcttcatcccgcgcgcggttgcatccacacccacgcggagcatcccgcacatccccatgggcgcaggctgggcggccccttcagcggcgatacccaagaacaacggccacgccttcatgggcagcctgacggtgctcgccgacggaatgcccttctcgggcggcggcgcgcacctgcacctcgactgcaacgacgtgggcataccgagcgtgcacaaggttccgggaatgttcctgcccacgggtgtcatcaacccgataccccccgccaggcagatactcaccagcccggttcccgtccctctcaaccccatggcggcactcgcccgcaagtgcacgggggcgttcgggcgtttctacaagaaaaagaccaagaagctggcggacaagctgcacagcaaggtcaacaagacgataaagagcgaatccctcaagaacatgctccacaaggccatctgtacggtcacggggcatcctgtggacgtggccagcggcacgttcttcaccgacgaggaggacttctggctcgacggcccggtgcctctgtcatgggagcgcacatggtacagccgcagcgactaccgggggcctctgggcaacgggtggcaccacgcctacgacatgggcgtcgtcgcggacacggaagaaggcaccctgacgctccgcatgagtgacggcatcccggtggccttcccactgccgacagcggaagacccctcgttcatcctctccgagcgcaaggaagcccgtctggaacaggacggctgctactgcgtgtgggacatggccgaggacctctactaccgcttcacccgcaaggagtacgattccgtgcgcctgcttgagagcgtgaccgactacaacggcctcggcatccgcttcgagtacacgaaagagggattgctacactccattacagacagtgcgggccgccgtctgagggtggaacacgacacgaggaacggacgcatccttgagatatacggcccgcatccggaagatccggagaaagagattaccctcgcctcctacgagtacgacgccgacggcaacatgaccctccagcgcaacgcggcaggagatgtgatgacatacgagtatgccggaaggctcatcgtgaaggagacatggcgcaacggccttgcgtggtacttcgagtacgacggtacgggcgtgggttcgcgctgcgtacacacgtggggcgacggcggcatatacgaccataagctcacgttccgagagggagtgaccgaggtgctcgacagccatggcgggctgacggtgtaccaccaccgtggcggccttgtgtggaagaaggtcgatgccaacggcggggaacacctgtggcgttacgacgacagccgccagctcctcgcacagacagacccgctcggtaacagcaccctgtacaaatatgaccgctgggggaactgtaccgacagctccgacccgtgcggcggcagcgtgtccgccgtgtaccccggcaagggggggctgcgcaaccgtcccatatccgttaccacaccggacggcggcacgtgggagttcggctatgaccgctccggcaatctggtgagccgcaccaaccccgaaggtgccgtcacgaggatgacctaccgcgacggtgcggtggcatcggtgaaagacccctacggtgtggtgacgaagctcgcctatgaccgtttccgcaacctcacggaggcatccgacagccgggggaacacctcgctgtacggctacgacctgctgggcaggtgcgtgagcgtcaccaaccccaagggtgcggtgcagaaaagggaatacgaccctgtgggccgtgtggtgcacgtgctcgacttcgacggcaacgacatacgcctgtcctacgacgggatagacaacctcacggaataccgtgacaacgtccagcacgtggagtacggctactccggcatgtggaaactgacaaggcgtcgcgaccaccggggcgtggtgaacttccgctatgaccgggaggaacgcctgcgccgtgtgacaaacgagaagctccagagctacgagttcaccctcgacgctgtgggaaacgtcaccgccgagaagggtttcgacggggccgtccgtcattacctgcgtgacaggggcggacgtgtcatcagggagacactgccatcagggacggaaagagaatacggctacgacgcctgctcgcgcgtgacgcgcgtctcataccccacggctggcgaccccgaccagacctacgcctacgggctgtccggcaggctggtgcaggcatcgaggggggaaagcacggtggaattcgcgtacaactccctgggacttcccatacgggagacggctgacggcaacaccatactccgcacctacgaccataccggcaggatactcacgctcgacagcacgacgggggcctcgctgcgctacacccgcaacggatacggggagcttgaggggttcacggccaccggcggcggcgacgccgacggcgcaggctcgtgggaatcctcacaccgccacgacacgctgggcttcgaggtggagcgcatccttccgggaggcgtcgtccgctcgttcgcctacgacgacataggccgtctggtggatgcccgcacacgcaaggattcgcgcacacggcatatgcgccgctaccgctggggagtcgccgacaggctgttgtccgtggaggacagcaggcgtggcgagacccgctactcctacaccccgacggggcagctcgacagggcggaataccccgacggcagggagcagtggagaaagagcgacccggtggggaacctgtatcccgacccggacatgaggctgcgccgctacctcggtggcggacggctggagcaggacggtgaatggcactgcgagtacgacggtgacggcaacctgacggaacgctacctcggcacgggaaagtggcttgacggcaagaaggaccgctggagataccggtggaacgccgacggctccctggcaaaggtggtgcggcccgacaagagggaggtggagttcacatacgacgcgctcgggcgcaggctctccaagagcttcgaaacgactgtgacgcggtgggtgtggaacggcaacgtgccgctgcaccagtggaagcagcgcagggaatactccgtcatggaggacaggtggaacacggacacggaacgccgcgacatgacggtatggctcttcgacgaggagtcgttcgtaccgatgaaaggtattgtcttggccggtggttcgggcactcgcttatatccgatcaccaaaggagtcagtaagcagctgcttccgatatttgataagccgatgatctattatcctatctctgtacttatgttggcggggattcgtgagatcttgattatctcgactccttatgatttgcccggctttcaacgtttgctgggtgatggttctgacttcggagtgcgttttgagtacgccgaacaaccttctcctgacggcttggcacaggcatttatcattggtgagaagtttataggcaatgattctgtatgcctggttcttggcgataatatcttttatggtagcttttttactaagatgttgaaggacgctgtagtatcagcagaattgcaaaataaggctacggtttttggctattgggttgaagatccggaacgttatggggtagctgagtttgatggagatgggaatgtcctcagccttgaggagaaacctgatactcctaaatctaattatgcggttgttggactttacttttatcccaatagggttgttgagattgcaaaacagatcaagccttctttccgtggagaactggaaatcaccagtgtaaatcagcaattcatgttttctcaggatctgaaagttcaggtattaggacgtggctttgcctggcttgatacgggtacccatgattctttgtctgaggcaagcacctttatagaagtaattgagaagcgtcaaggcctaaaaatagcttgtttggaaggtattgctttccgtcagggctggattgattcaaagaagttacgtgaactggcttatcctatgctgaagaatcagtatggaaagtatttattgaaagtaataaaagagatagaagggtgagcgaatccttaaagcataaaacggttaagggagtgggatggagttttgctgataacatctccagttccggtgtttcatttctggtcggattggtacttgcgcgtttgcttactcctgcagaatatggtattatggctatgattgccatctttatcgctatttcgaattctattattgacagtggattctccaatgcgttaattcgcaaaacggatataaagcgtattgattataacacagtctttttttttaatctggtggttggtgtcatcctatatgtccttctttatttttgtgccccttctatcagttctttttttaatgaacctatattgattccagttacaagagttataggccttgttctaatcatcaattctttaggtatcattcaacgcactattatggtgcgggagattgattttagaacacaaaccaaaatctctttgatagcttctttatccagtggtggaattggcatcgtgatggctttctatggctacggtgtctggagtttggttggacaacaggtctcccggcagttattgaataccgtcttcctctggctttacagtgcttggcgtccggtgtgtgagttctccgcagatagttttaaatgcctttttggctttggctcaaaattactgttgtcgggtttactcgatacgctttacaagaatatctactatatcgttatcggacgcttttacagttccgcccagttgggtcaatatacacgtgccgagcagtttaatacaattttttccagtaatctgactagcgtggtacagcgtgtcagctatcccgttctgagctccatccaggatgaaccggaacgtttgcgtgaagcttaccgccgtgtgataaaggttaccatgctgatctcttttgcctgtatgcttggtttggcggctgtggctaagccattgatactgttattaatcggtgagaaatggctggtgtcagtctcttatcttcagatcatttgttttgacggaatgctatatcctcttcatgccattaatctgaatattttggaggtgaaaggtcggtccgacctgtttctcaagttagaaatcataaaaaaaataatagcggtcattcccatttttctaggtatcatgtatggtatagaatatatgttgtggggtagtgtcttaatctcctttatagcttattttctgaatagttattattccgccggtttaatccggtatcctgcaatagatcagattaaagatgtgcttccgacgttcgctgtttcattgtctgtcgcttttgtcatgtggattatttcttttcttgatgtttcaatatatgttatgctccccttgcaatgtttttcaggtcttttgttgtcttttcttgtatatgaaaagttgaatctggaggaatatcttgaaatcaaacagctcatactctcttgcgttcaaaaaaagtaatataaatattaagatggatgaaaaactaatcacggttacttctccacttcttccttccttggatgactttattccttatcttgaggatatctgggatcgtaaatggctcactaataatggtcattatcatcagaagttggagcaggctttatgtgagtatttaaaggtaccttatattagtctttttactaatggtacacttcctttaatgtgtgccttacaagcattacgtataaccggtgaagtgattacgactccttatagttttgttgccactacccattctctgtggtggaacgggattaagccggtgtttgtggatattgatcctgtaacctgtaacctggatcctgaaaaaatagaggccgctattactcccaagacgactgctatcatgcctgtgcatgtttatggcaaaccttgtgacacggttcgtattcaagagattgcggataaatatggtttgaaggtcatttatgacgctgcccatgcatttggtgtagaggtaaacggcaagtcaatacttgaatccggtgatatgtccactctgagttttcatgctacgaaggtctataatacgattgaaggtggagctctggtctgtcacgacgaacagaccaagaaacgtattgattatctgaagaattttggctttgctagtgaaacgactattgttgctcctggcattaatggtaagatggatgaagtccgttccgcttatggactattgaatttgaaacaagttgattccgccattgaggctcgtcgtaaagttgccgttcaatatcgtgatgctttgaaagatatccccggtatccgtttcatggaggatatgcccggtgtccgtcacaactactcttattttcctatttttataaatgctgaggaatatggtctgacccgtgatgaactttacttcaagttgaaagagagttttaaaaaaaggtctttaaatctagctgaagcataaaattagaagtttaacaatcccaaaaaacaacgagttatgtcacgagtacactatttagaaggagattatgaacagttagttattaatgaaacgatagacggtcttttttccagttatcgtatagaccgcaattcattgccaaaaggatttttcctttatgagattagatgggatgacagcttatcttcattggcagagattagcccctctgtggtggtgaatcatgcaggttcattcattacaaagtcaccccttgaatttgatgcaaacaatagcatacggataacctataccaattttatcgagttctgccagtttggtgagtgggcttatgagaaactggctgtattggattgtaattccggtaatgttgcggtgataagcccagacaggagattgcagaccactgaagagattgagatttttttgagtgggcattgtggctatcatctgagtgagattaattggatggtgatgaaaggcgatgtgctgtttttgaacgagaacgatttttaatgagtataaccgtaactgcctcttggaatggggcaattacataaaatattataagtatgaagtggatagataagatggtagaacgcattacccgaaaagaaactgctttaaatgaccacttttgtgtaaatcggcatacggttgtatgtcagagtggtatgactgattatgtttctgtaacgattgataataccgatggttttgatttcgatttttggacaaaacaactttgttttgagaaggactgtaaatatcgttcggagataaaagcggcttttgataaaatctatggcacaaggaatatagaatgttgtgaataatgaagtcagaaaagtatgataccaaaggagataatgaaactttatgaaaagcttgctttcagtcggggatatgaagaagcctttcgggattttttggatgtttgtctttactatttgtctgtcgggatgttggcggaggattatcgtagagtggaaaaaagatataagccatatgaaatggaactttttgttcaaatgttttatagggtgtctgaatattcggaaggattttgcgatgtcttgggagatatgttcatggagtgtgtcagtcatgggaataacggacagttctttaccccgatacacgttgctgatttgatggcatgtatggggggaaataggctgaaacctaaacagtcggtctgtgattcgtgctgtggttccggcaggatgctactttccgctgtaaaaaaatgtgcggaagagaatgatggaggaaggcttttttgttatggctcggatatagatttgatttgtgtaaagatgaccgttgtcaatctgatgatgaatagcgtacccggtgaagtcgcatggatgaatacattgacaatgcagcattggagaagttatcatatagatttacagctgatagccggagtatggttgcctattttaaagataacggaagcaggtgacacttcttttattaggaaacttgaaaatgcaatggaggataattctgaattgaagaggtcgattcagagcaacgcaagggctacgcagctgacttttgatttttgacaagataaatatgtaaaaaggattttggtatgaaagcaataagaacaaaagaggtgaatgagaacgtcaaagcggcgaacagttgtttgcgtaaagcgaaatggcaggctaaggaattggctgtttttacaggtgaagtagtgcgtctgatggataaggaagggcattctctacaagggttctttaatcgggtggagtttgttctggtggacggcactattaaattccgtgtagttataaatcctattcttgaatgtgagaactgtataatggcttcttgccatgaagactatctttatgaggtggtctcggtggaaaagtttacctataaaaattataggtatcatttgtaatgatattgtattttaatgattataaactgatttatattataacaatgatgggcaaaattaataatattcccgttttgaatgaagatgttattcgtttggttgtactcaatgaggaaattattgggtatatctatccacgaaggacttcttatgtggtggcattggagataaagccgggacgtactacctctttggctacatctgtcaataaacaatgcatggttttgttgagtgataaggttcgtttggccacggaacaggatttcgatgattttcatatatgctttgatggtttcagaaataacactatgtattgttataatcagggaacggaacctatataccttcaatgaagcacattctcccttcttttggattagggaagggagggtattttgctgtccgctactttttggcaagcaccccaaaaaagtagcaaaaaacgcttggagttactggtaatcccattaatttgcgttcacgcagtattctttcccaccctccccttcatcggaatgactgttctcattcccggtttacccgtaatcatccgctatgcggctgattatgggtaaaccggaaaagagaagttccaatcgtaagtgttcggtgaactcccttgacgagtaaaggtagggtgtacgtcctgctcggcgcaccttaaagtaacattgaggggtatttacccgtgcttgggctacccaaagagtgcatcgaggggcatttgtccgtgcttgggctaccaaaagggtacaccaaggtacattcataccttttgccccacctaaagggcgtttaggataatgcgtaggaggcgagcttattgtaagctttcagattatccggcagtaattctgccaagtctgttgagtagtcattgtcatagtcatggatatgttcgaggaagtagatcagccatgtacggaagtccacaccggcagatttacagcacccgaagaacgagtagagtaccgcagcatcttccgcggcgtcatggttgccacaaaataaatagtttttgcgtccgcacgccacgggacggaccttattttctttttcttctggcatgggcccaacagcccagcaggataatccctttcttcgcgtccagcaaatcgtatctttcgtaaccgtccgtctgtatggctccacggaacttgctgaagagcttcaagaccaccctacctgcacgggagccattatcataatagaaaaactgacgtccggtcataacgctgcgcacaagccagatgtatccttttaccgtcttgtgtttctcgtcatgtatgacagggattgtagtctcgtccgattgtatatagtccgtttgtaatatcaactcccagagtcggaagtatagtggccttaaaagatcggccacatctttgaaccagtcgttaaccgtcgatggcgggagatgcacgcctactcgcctgaacctttccaactgcctgtggaacgggaggtggtccacatacttgtttatcatcatttcagccagcaacgaggaggacgcatagctcttggcgatcggcatgaccggtactgttcctgtacggaactcgtccgtgcctttccgcttggccgtatgccgtattattttccggatataaaaccgttcaggttcatacacgaggacctcggtcacttcctctccgggaagaagaacccattcctcttcattatacccttcaggataaacatgctcctccctgcgttccagattttcagggagaggattacggaccggacgctttcctgccatctttttacgggcgatgaccgcctctctggtagcttgcagctccttttctgcttccgcagcggcttccgcttcttccggcaacatgtcaaaaccttcaaaatccagccatctgtcttgtgcgtcaggtttgataaacttttccgctttccgcccatataattgacgttccagatatgccacccgttcttccaacttgctgatctttgcctcctttttggcgagaatggtatctttttcagacaactgaagctcataagcctccttttccgcaaccccaagaggctgcgcggacaccttttccctcaacctgctgttctccctgtaaaggcagtcgcatttatacatgaggtcttttataagggcttcgttttctgttgacgtatttgacataactgtttctaaatatgacactaagatacgcaaaatcggttaaaggacaatgcgacatgtgttataatttgttacaattgaacgttacaggcatatttcttttatgccgtctgaccttgctgctgtctataccctggaccatcattacaagatcgctccagaaggtctccacgactttgatgcggccttcttccgtatcaatagaaggtacgtggaagtacccttgttccaatttcatgtgatatattaccagtccaccatattccatgtggaggattttcatagaggcgcaattccttgatatgaaaatgaaagcgtctccatcacgcacattcttgcccatctgatctgtcaccagaccgctcaaagtataaaaactcttacgcatatcggtcggataaggatacagataatatctgtttgactcgttaagactgaacatcggctgattaacggttaaggtttaaaaatataagggtctgtaaaatctctgatgacacgggaccatttaaccgcacagtaacaccattgggatatactatttcacagacactttgtggctgtccggaagaaggaaaatcaggagaaaaaaaagatgctggagctggagttttgccggacagggcatgaccgccagctcccattttaaccggtataaacttacctttggctgcggcattcgttttgggacctttcagttttgctttccaaaagctgaaacgtttacacttgattccttcattagagcaaaaatcctttattgttaaaccgctttctttatatcgggcataaatttctttgaaatcgtccattgtccattgaactcttgtcaccataattgtatatttttaaatcatggacaaaggtattcaatgaaaggattatttatagggggagttcaccgaacacttacgattcaaggcaatatttttcaaaaattgaagatctttataattcagcataatgaataccaataatggaataaaaatgaggtattctatttgagtacatgatataatcaaagctatcatatatggaataaacattcttataggaaaaaaatgcttcaaagtatagcttacactcttttctcttcttagaatggtgtcaccctcgtatgccataaggaatgaggatatcatatatgcaacaagaatggcaattgttatataagagtattccacattcagtatcttagccaaacctaaacccaatattatatttacaatcagagaaaccgctgaaataaagcctgctttacgttccttgttttgagcaatcagcatattggaatatccgtaactgttggtattcatcaacaccgcaagtgctatcatattcatagaacttaatgctggcatatatttcggtataaaccatactaaaaccgggaaacaaatcattgccagataaataagcatatgtgaggttaatatataacctactcgcattttctctaatgtatcagcctttttcttgttatcatcagaagacatcaagtcaattgttttaggaaagagaattgtattaaacgaatccaaaagaagcatcaccgcattagctatagtaaatgaaaacgtaaaataaccgaactcttctactgtatagtttacactaatgatggtacgtatagatatcaatatgaagtaaaaacaagaattatataagaaaaggtataaacccttctgtagtataaacttttgtttctgtagttgcaaagttctgctttgtctccgtggaaatactccctttcgtatgcaaataacagccgttaatatgcaagccaaaagatttgctaaagttaaagcaaacaccaatgtattttccttgaaaaaccatacaatacacagatttaagaatactccaatagacccgattactgataacgcattcacttcatttctaactcgaataatagttgtaagaatcgaattataatatgtgagtatagaaattgctataatcaagggaaaatatgatccaaggtcatactcaccccatttagtccacccagctatacttacaattacggaacctattacaatagccatgttgagatatgtatacaacgcaaaggcattgtatgaatacaggtccccaacttgtcggttctccttattatgaataagaaagacattcaatgcatgtggtactccaaagtttacttgcccgaaataactgataaccagatttaccataccatacacacccaaatagaaaggacctaatctgacggctattgcgagagataagaggaattgtagtgcgtatgtaatatagcgagtagttacatatataactatcttattcttgagtattggcataaaatttgggttttatttcaaatggtccccaatattttttgactactgcaatttgttcaggggtaatgataggctctcgtgagttaaatacagctttaatctcagcatattccctgtcacgtatagcctgaagatgatcagaggcttgcgcagatgctgctttttttatagacgtgatgtcttggttaaaaatataatgaggagttcctaaacaaatactataacctatatgcgttcctatgttgttagaaatagtcatatctgccaactccatcaaatccctttgtctattcaaaaagtaaggatcattacgagtacctgatgatactattctataacctttattcctatactgtttgtcaaaaccctgctgtatatcataacctatcattgaaataagaactgtatcataatctttcgccatttcgtcaatacattgagaaaactgattgaagtcgtataaatcatcgcaatcttcaaaactgtgtgttggaaaaacaagcaatattttaccgagttgagcctttaatgctttcagtttatccttcgatttgaaataatcgacatattggatataaggccctaccataataatttctttatcaaagtttttaccgaactctttgagtatagcattctttcgataattactatacgtataaattgtatcaatacagggcattatacactcgtcctttaacacatattctgcaaaataaagcccatgttctatcatgcaatgcttatgaaagttctttccagttgcattttttatagcgtgaatattaccgtaacatttatttcccagtataccgggaaggtatggataagcatacaagggaatgtcatgagaaaatctctcaggatggaagtaatccacgtgcattcggaacagcctcattatgtgatacaatattccaaaaatgctatatttcaatacgtctttatacataatttgctgatggggtacagacgagtaccggaaccaccggctaaaacaatgcctttcataaagttactatcatttccacaatattatctaagtaatttcaaatagacaaattcccgaaccttatttggaatcaaacgagatacaaaccttattgttacatttcgaaataattcgtaacaattaataaaccccattcttgcaaactctctttgtaaattcaattcgctaattgcatattttaaacctccacgtcgcttaaacatctcacttgaaaacctaaatgctagaagactctcttgaatattataaaacttcgcgccattcatcaacatcctaacccaaagataataatcttcaaataatggaaaatgcctatatccgcccgcagcaaatactgcatcctttttaaacatcacaactggatgattaataggacatcgtttctttgcataaagatatatttcattatgatattccggaagttttcttatagaaacaacatttgaagaaacattttcaaattcgctaatccaagcaccaactacatccaattccggatacttttcaaatacagtaatttggctttcaaatctgtttggagttgcaatgtcatcagtatccatgcgagcaacaacatcaaaagtacaatacttcaatccgacatctaaagccttacctaaaccctgattctcagacaaagctaaaattttaaacaaaccagtatattttctcacataagaatcaatcattctatctaaatcaatagataattgaccgtcctttactaaaactaactcatcaggtaatctactttggttcaaaatactatccaaactctgcttcaaaaaatcaggattttctttataatatacagaaagtaatacagagaacttcatcatttcaattttcttatagcacgtaccaaacagttatgtccctttcgcccaaaagcatagtataaaattttgtgcatatttcttttaagagaatacttcagcccccgttttatccactttccatcaaaatgatgaatacaaaaggtactatcacttatatctatcttgccaatattataatctttaggtgaaaaataataatatggtttaatatcaaatgccttttcttgaataattctatttagtaataaaggcacaggcttagtatcaaacgaaccatcttctttcacaaaaggacgatttgcatagtaatctaaacaagatttcacccaatctgcacctttttcagctccaataacagcagcttcaatgtctccactagcttcttctcccaaaaattgcttttcaatcaaaagcgatttaaaatctttaagcacctcaacatcagcatctaaatatattcctccataatgatacaaagcaaaaaagcggatataatctgcggcaaaagcatacttcttattttcataagcttgctttaaccacaaattagaattaacatcaatctgccttgtatcccataacataaattcataatcggacaaaatgttatgccaagaattaatacacttatttattaaatcaggaaatggatcaccactcaaccaacaataatgaataattttaggaatcactttatttttaattttagtttatcacaaaaagaatatgctatcaacaaaataaaggtcacaatatttaacgtcaagatatacaatataaagcttgtattatttttattggatctcttaaatatactataaaaaaaattccgggaaaatccagtaagaaatccgtctaatgcaactgcacaaaagcctaaatctgcataagcataacctaatccaaaagaaggcatatatccttctgcagaatattctggatatattttataattcaacaacgcaaacccatagtcaacaggcttatctggccaaaacaatcgaggaattaatttataccaagaacttatatatatttgcccattataataatccatttgatttctctgtaacatatcaataacaatagactgttgtttatatagatcaaaataagataaagcagccattcctatttctgtttgagagctttgagaataatgatacagtagcattaaaataaaagaaaataataaaaagaatgacatataagtataattaacttttttatattcttcatacatcgttacaaaaacaattaatgtagaaagtatagccattttactacctgaaaaaatcaaaaagaagaccactataaatataccaacagtaagtttttgtgtttttaaaaactgaagtataacaataataatcagtaatgtttttgatatttcatatagagatgcataaggagaaaaaacaacagcttcatagaaatctctaaccccctttaaagataatccataagatatttcggcctgcccaccgtagtttattgccaagtttaaaataataccggtattgtttttagttgcttccacagcgtggtccattttctgttttacaacttccggcaaaccttcacgtgaacccataaaacgaacctgaacattatttcgattaaattcttcaatctcactggtcagataacggcttaaaagctccataataaaactgacctcagtaacaggccgtttccaattttctgttgaaaaagcatacgcgctgataactttaacaccaattttatcagcaattttaacaatagtttttaaagtttcagctccggcctgatgcccaaatgttcgcacttttccctgcgctttagcccaacggccattaccgtccataataattgctatatgctgcggcacattagccaaattaataccatcgatatcgatatttacgtcggggtttgtattcttcttgattttgaacaagctgttaaacacaagcacaccaacccttccctggaataaataaaactgacagaccccctctaagagggggccttgcagtcctaaaaacttaaaatcaaggttgtttaatagcacctacagggcaaacaccagcgcaagcgccgcattcaacacattcatcaccgatttcatatttaccgtcagcttctttaatagcacctacggggcaggtagaagcgcaggaaccgcaaccgatacattcgtctttattgattactaatgccattctccagcacctcctttctatatttttttactgttacaagagctactttattgtcagacagcaaactctgcctaaccacatattcaacagctatcttctccgccacaacttcgttttgccggcgcggcggctgcgtatcagcaaccgtatatccgatctcggcagtttccagtctggcaatagcttctgccaaaggcagtgccaacacatcaggtatcagcatcagatctccataacttccttttctttattagccatgatattatcgatttccttgataattttatcagtcattttctgaatatcatcagtaccctttttagcttcatcttcagtgatttctttagccttctctgctttcttaacagcatcgttggcgtcacggcgcagattacgcacaatcacacgtgcatcttcagattttttatgaacagtttttacaatctctttacggcgttcttctgtcagctgcggcagattcaaccgaattacagcaccatcactgttagggttcaatcccaaatcagatttcataatagctctttcaatatccttcagaagattcttctcccaaggctggataatgatcattctcggttcaggtacagtaacgcttgctacctggttaacaggtgtcggtgtgccgtaataatctaccataaccttttccagcagagccggagtagcacgtcccgcacgaacagaagcaagatctacgcgcagtacgtcagtagttttgtgcattttactttctgctaattcaatgatttcttttactgttgccatgattattttcctcccaccagggtaccgatctcttcgcctaaggcagcacgcaaaatgttacccggtttatcaatattaaatactacgataggaattttattatccatgcaaagactgattgccgtagaatccattacactcaattttctttgaataacttcgatataatcaagtttttcaaacattaccgcatctttatttttagccggatcgcaatcataaacaccgtcaacaccctttttagccatcaaaatcgcatcggcttctacctcggccgcccttaaagcagcagtggtatctgttgaaaagtaaggattaccagtaccagcggcaaaaataactacacgctctttttccatatgacgtatggcacgtctgcgaatatacgtttctgcaatctgacgcatttcgatcgctgtttgcacacgtgttgggactcccaaagtctccaaagcatcctgcagcgccagagaattgataactgtggcaagcattcccatataatctgcagtagcgcggtccatacctttcgaacttcccgataaaccacgccagatgttgccaccgccgttgacaatagcgacttctaaaccacattccgtaacatctttgatttgtgaagctatggactcaaccgtttccgggtcaataccgaaccctttatcaccagctaaagcttcaccgctcaattttaaaatgacacgcttatacttcgatttctccgccacttccacgacctcctattttctgcaaacatcgatatggaggatgacggcaggctgctcgggaaatactacgattatggtacctatacctccaccggagcgatagacaaccggcattccggattgcgtggaaaactccgtttgacaaagtacatggaggacgaagaagcggacagatacagggagcgttaccctgaactggagatcgtgcaaccggcctacagcatcatcgagtcggacgagagcgtaccggacgatgccaatatctccaacccggacaacgagaccggctataagtatggaaatgcttacgtcatgaatgcccacgtggcggcgatcctcaagaagcgccaccgtgtgcttgccaaggtaacgaaaaagcccacgagccgtaaagtggagatggccggccagacagttgacgtgaacaatccggacggtgagatgacctattgtcctttggatgacaccaacagcaataaatattacgacggaagcgcagccaaacttgacagcagcgagggcgactggatgatgtacgagccgttcttctggtcgaaaggtgtcaatgattacctgaatgagaaatattacagttgttacagttccaacggccccgacgatatgcctcccatccccgaagcaaccgttttgacactggatgccatcaaggaaacgcagggcggctggctgggtgaacgcaagattatgagcggaaagcccacgctgaaggaatcctataccacggacaaggcttattccgtgtgcaaagtggacgtgtcgggctacaagcgtgtccgcttcccgagtgttcccggcacagggcttatcggcagtgtgtttgtggatgatgcaggaaacattctgaagaacatcgtggtgccgaccatcggcttgaaatttgaagccggcatgtatctgatagtagacgttccggaacgtgcgaccgccctgcatttctccattctgaacacggctgagtttgactgcgtggtactgagccacagcgacaagatagaggacatggaaccggattgggtggccaacgaggagcatctgtgtgccgttgtgggcagttcggtggtgggcagtaagctgcgtgcctgcataaccggaaacactacagccggcagtatgacgtggacagacttccactattacagccagcagcggggcatgcagcagatagatgcgctgatgcacagccgcatcgcgaatctgagctatgcccggtacgggcgcagggacatgcaggaacagtgcggtgccggacagcataactacaatagaataacgggcggaacggcagaaaaaggcatgacagacaccatcggctatgatgaagcgtatgccatcaacaacaaaatcacgaattcgttgattgacggtctggttcaccagtatgcctggtataagagccgggacgaatacgggcaggtgactgtggtgcaggtgaacaatatctgctgcctgggctatgaggacatctacggcaacaagtatgacatgatggacggcgtggacctgccgaacgacagcggcaacgtgggcaaatggcgcatctggatgccggacggcacggtgcggtgggtacagggtaaaacggccagtgaccaatggacaacaggcgtggcacatggcaagtatatggatttggttccggtgggtaatctgaacggatcgtcttctacctactattccgataagtactggataagcaccgctatagtccgtgtggtctatcgcgggtgctacaatgcgtatgcgggtggcggcgtgtcgagtgcgaatgcgaataacgatgcatcgagctcgcacacgaatgtcggctcccgtctggccttccgcggcaaactcgttcgggcggaaagcgtggaagcgtataaagcgattcgcgaagtgttgtaagcgcaaagcgccaaagcgtggagcgaagcgactaaaacgaaagaacggtgttcggatggtttccgaacaccgttcgtgttattataaataccggcgtaagccggtcgaaaatgttttaagaaaatgaaatttgatagtgctttagtatgtgtgagagagtgcacaacacaccaatttatactatacaaatgtagcgatttttggcgagattaccaaatttcttagtaataattagaagtgagaaattaagcggaaaagggcagggtagagggggtaggggtgcgaaaaaaagaacgtttcgttttgggaaaaagaacgtttcgttcactggactacaggtatagactaccgccagccgcctttttcggactggctcattgaggccggcagacctgacgacctcgggctgtatctcaaggcagcttcacagactatccccaaaaagaatatgctggctttttgggataccttcggggaaatattcggaatgcccatgcgtatagcacgcaccacctcgcgcgaccagaaagaaatcgaccgccttgacaagatgctgcgtgaagccggaaccgctctctccatggtggcaggaatggaaaccgaaatcgaatttgtggaaagcggcaagggagatgcattcaatgtctatgacaagcgcatcgatcgggccaattccgaactgtcaaagcttatcatcggacaaacgatgaccattgaggacggaagcagcctctcacagtctgaaacgcaccttgaagtgttccagaacctcgtggaaagtgactgcgacatgctgcgggatatagtgaacaaccaactcattccgcgcatggttcgtcacggttttcctgtcaagggactgcgttttgattgggactactccattgactacactcccgaacagcagaaagcctacgaagaaatggtactgcagcactacaaggtgaagccacagtactttgaggaaaaatacggcattccgtgcgaggagaaggaaccgaaggaagagccggacccggcagatccgaaaaagaagaaagacgacaaacaggctggaacgctatcccgttttttcgactgagccccgaggattattcggggctgcatctacgctacagttcattgcttggcaatcataccctccaactctcaaaagaggacgaggcaaaattgatgcgtgacaagcttacagagatgttcgaccgcatgatgaaagccctgttccgggagcagggggcaaaccttgaaatcaacatactggcttcagaagaggcgcaggactttatagagacgcacgcctccgtcctggactcttcattccggcaggtggagatgtccgaggccatgcgagggcgcctgcagaggtcggattatatattctcaggcctaaagacgttccatgaactgaacgaagccttcccctccctgctggatgagaacggcaatcgaaaaacgttcgaacgctttttgaacgatgtccggaagatagacgaaacctataatcggggctacctccgggcagagtacaactttgtgcaggcttcggcgactatggccgccaagtgggaacggttcgcagaagacggggaccgctacaacctccagtaccggacggccggggatggcaaggttcgcccggaacatgccgaactgcatggggtaacacgacctatggcagaccccttttgggaagagtatttcccgccaaatggatggaactgcaggtgcaccgtagtccaggtacgaaaatccaaatatccggaaacgccctacgatgaggcaatggcattgggcgagtcagcccttcaaagggacaccaaaggcatcttccggttcaacccgggaaaagaacagaagaccatgccggattacaacccatacaccatcaaaaggtgcagggattgtgatatggccaaagggaaacttaaactggccttcgttccggacaacgagctgtgcgccgcctgcaaaatactgcaaaaatgcgccggagaccgggaaaagtccgcacgagctatcgaacgtatccattatctgcatgaaatggagcctctacttcaaaagaaagtggaaaagaacataaatggcaaggacttgaatatcggctttaccaaagagggcaacaagcacttgttctccgacacattcggacggacacgcatcgtttccaaggaggacttgaagaacctggattcacaccttgaacgtgccgaatatgtggatgattccgcattgactcacccaaggacggacaacgtggaacacttcttctacttcaaagttaaaatcaatggaaaatgggtaaggcttaatgttgccaaagaagtaacaagaagggataacggttatatcagggaggatgttgaacgtgtcgtaagtcctttggcttttgttgccgcaagtgctaaaattggtaaaaatgttgctatacagccgtttgctgtaattgaggaagatgctgaaattggtgatgacagtgtaatttatccgcatgtttatgttggaaagcatgttaaaataggaaaagcttgtaccttttatcctcaggttacaataagagaaaattgtgttataggcaataatgttgtattgcagtcaggatgcgttatcggcggcgatggttttggctnnnnnnnnnnataaaaagactggcagacacagcagtgtactgcaggctggcaatgtggttttagaggatgaagttgaaataggaaataatacctgtattgacagagctactgcaggcagtactattgttggtgcgggaacaaaaatagacaatcttgtgcatttaggtcataatgatgttttagggaaaaattgtctggttgtagcccatgtggggatcagcggcagcgtgactgttggtgataatgttacgtttgcaggacaggttggtacagttgggcatatcacaattggtgacaattgtgtttttggcggaaaaacaggtattaccaataatgtaccttctaattcgttttatgcaggatttccggcacgtccgcataaggaatggcttaaacaggaagcgaatctcagaaaaatcggcgatttactgaaaaaggttaaagtactggaagaaactgtagctaaattggaaaaataagaaacaaggcggtgcaaaagcagtgcttgcttattatgtggttaagtttttcagctggattatgtgcgtggctcctaaatgtttacgtaatttaacagctgcgatattaggcggaattgcggttgttgctactccaaaatggcggatgcaaatggctgcagccaatatacaggagtgtcttggcgtagataaggcaagagctcagcagatagcagagaaaagtttgcgcagatttggtagaatggtagtagaagtaatgcgcttccctttgttaaataaagataatataactaagcttgttaatgttgaaggcctggaatatttggaagaagcctataaacagaataaaggtgtcattattgcaacaggtcattttggcaactgggagcttttaggggcaacgattgctttgcatggctatcctatgctttctataacgagaaaacaaaataataaatatatggatcgcttcattaatgaatatcgtgaaatggtgggacaaaaggttgcctataatcgtggcgaacatggtttgcttgctatcagcagaatactgaaggagaaaaaactgcttggcgttctatatgatcaggatactaatgacgacggtgttgatttaaaactttttggaaaagacagtatcattcctttaggtgctgctgccttatcgcgaatttatggatctcctgttttaccatgttttattcataatagtgaagagggcggttgtacggttaaaatatatccgccgctttatacgcctaagagcaaggatagggaaaaggatttttatgatgtgactcaggagctggttgtaattttggagcacgagatcatcagtcatccggagatgtggttttgggtacatgaccgctggaaagacgggcctgagagatttgcagtcaggaaataaccggggaaaggcaggagggaattttgaaagaaataatgcagcaaacattggcagctcctattgcttattctggcatagggttgcactcaggaaaagaagttgcaatgaaattattgccgggaaaagagaatacgggtattgtttttgtacgtacagatctctcggggcatcctgaaatacaggctttagcggagaatgtaagttctacggttaaagctactactgtcagtgaaaatgggaccgaggtatttacagttgaacatttaatggcggcattttcaatgatgggcattacatcgatatggaggatgacggcaggctgctcgggaaatactacgattatggtacttatacctccaccggagcgatagacaaccgtcattccggattgcgtggcaggctctgcctgacaaagtacatggatgacgaacaggccgaccggtatcgtgagcggtatccggaactggagatcgtacaaccggcctacagcatcatcgagtcggacgaaagcgctccggacgatgccaacatttccaacccggacaacgagaccggttataagtatggcaatacttacgtcatgaatgcccacgtggcggcgatcctcaagaagcgccaccgtgtgcttgccaaggtgacgaaaaagcccacgagccgtaaagtggagatggcgggccagacggttgacgtgaacaatccggacggcgagatgacctattgtccgttggatgataccagcagtaataaatactacgatggcagcgcagccaaacttgacagcagcgagggcgactggatgatgtacgaaccgttcttttggtcgaaaggtgtcaatgactacctgaacgagaaatattacagctgttacagttccaacggccctgacgatatgcctcctgttccggatgtgacggtgctgacgttggacgacatcaaagacacgcagggcggtttccttacagagcgcaaacttttgagtggcaaacccacgttgaaggattcttatagcacggacaagacctattcagtctgcaaggtggatgtacaaggctataagcgtgtacgttttccgagtgttcccggtacgggtttggtcggcagtctatttgttgacggctccagaaacgtggtcaaaaccatcgtggtccctacgatcggtctgaagttcgaggccggcatgtacttgatatcggatgttccggaggacgccacggccttgcacttctcgatcctgaacacggccgagtttgacaaggtggttctttccaactccgacaagatcgaggatatggagcccgattgggtggccaacgaggaacatctttgtgcggtagtaggcagtagcgtggtaggtagcaagttgcgttcatgcataacgggtaattccacgacggccagcatgaactggatcgactttcattattactcggttcagcgcggtatgcaacagatagacgcgttgatgcactcccgtatagcgaacttgttttacgcaagatatggccgtcgtgacagccaggaacagtgcggaggcggtcagcatacgaacaatcgtatcacgggcggtacagccggttatggtatgcaggatacgatcggttatgacgaagcgtataaaataaacgacaagatcacgaattccatcgtggacggttctatccaccagtacgcttggtatcgtgggcaggacgagtatggttctccgaccgtgactcaggtaaacaatatcagttgtctgggctatgaggacatctacggccataagtacgagatgatggacggtgttgatttacccaacgatagtggcaaccaaggtaaatggcgtatttggatgccggacggcacggtgcgttgggtgaagggtaaaacgaccagtgaccagtggataacaggtgttgctcatggtaaatacatggatatcgtaccggtaggaacagctaacggctcgtccagtacatattattgcgataaatactggataagtaccgcagccagccgtgtggtctatcgcgggtgctacaatgcgaatgcgagtggcggcgtgtcgaatgcgaatgcgagtaacgatgcatcgtactcgtacacgaatgtcggctcccgtctggccttccgcggcaaactcgttcgggcggaaagtggctttcgtttgttttacttatctgcggatcgagatccccatgggtggcggtatgaccggcaaaatttatatcggtcatgcttttatcctcctgtctgctctgattctgggggcaaaatacggagcgcttacaggtgcaataggtctgtcccttgcagacattttagccggttataccacatcagcaccgccgacttttttagccaaatttctattgggactggcggtagcctttattgctcataaagtttttaacctggctgcggcagatgacaaaaaagcgactaagatcgtaactatagcggctgttttcggctgcctggtcaatgttatcaccgaaccgctgattcgctatggctttaaagtcttcgttttaggacttccgcaccagatagcctatctatctgcaatcaactgtgctgtttccatggcagtaagcgctgtgccatctgttattttagcagttttcctgtataaagcagtgcagcatagtatcctgaaaagctataaatttgtttaaccttacattcacaatacccctaaaaaatgaaggccgctgcttttataaagcagcggccttcattttttataatcattgttttattttaatctatcatttacagcaataacagcagtcctgcaagggaaactaacgaaatacagcctgcgacaacttttttcatgcaggaaatcttcttctccctgctgtgatcaggctcaaataaagctgctttttctttagctgaagcatcgataaacgctttagcataatatccatccaactcaagcaaactgtattccccattctcaaattgaacggccagctgatacacagatgctttaggaggttttaacactgcccccatgagctcctgaccatattcttctgtcatcccttcaagtgcacaatcagactttcctgcaaaagcatctttgatagcttcctcagttacaaattcccacgtatgaattgtttctttgctgatgataattccttcatcaggttctttaaaatgcatcttcgttacgatcatacaaactggatttaagaaaacagcactgccagacagatgccccaggatcactttatttttagccataaaattttcatccttctttacgacagatttttactatcattacagacttggcaatttacactttctccccttcttcctgttattgatccgtaattttctctgctattgctgctgtttatttctagctttgcggcaaagctcctgcctgcctcctttcacttttacacgaaatttacgacaaaaggcacagtactttatcagtactgtgcctttatctgcaagataaccaaactacgcctgtcttaatattttttatctgatttttacaccgctctgattatttctcagctctgttaatagcgcagaggatacccaaaagcgcagctacgttgatattactgtcgataccaacaccaaagatatgtccattaccgggaatcttcagttctatgtaacaaatacccttcgcgtcagaaccgcgggaaatagcatgttcgtgataattaacaaattcatagccctctacgccgattcctgccagcgcctggaagaatgaatctatcgggccgttgccgacaccggcaacttctttcatatcaccacaaacatcgattttaccttcaaaacgagtatgtgtagtgccatccaactcccgttgttccaggaagctgtgggaagccagtttgtatttaccatcaaactctacatattcacggttaaacaagtcaacgatctgttcttccttcaattcatcaccaaaagcatcggaagcagcctttcgataaactccctcgtataatgggtaacgtatgttcataatatcgtttattcattttatcgttctatgatttattgttacatcaattcaaccaaaagatgtgcagggttctatagaagttgatatttttcctactaatggagcggataaaagggagtttccccccttttcccttattttcctgtgataaatgggataaagcggtatttttatccctgctttcccgccataattggtataaaagggtattctttcccttattttccctatttatcggggataatgaagataaaaacggcactttattccctattttcccgtcttgattggtataaaacggtagttttcgcgtgtttaggcgggatttatgaaggtatcaggagtctttcttgggagattccggtggcgtaacggataatatcttgccaccggataacagattgtcaggtaataattcggccagatccatcgagtagtcatcgtcataatcatgtacatgttcaaggaagtagatcagccacgtgcggaagtcagccccggcagccttgcagcagccgaagaacgagtagagcaccgctgcatcttcagcggcatcattattgccacagaacaggtaattacgtctgccgcacgcgacaggccgcactttattttctatctcgttattatccggtctgtagcgaccgtcaagatggtatctggagagtttgtcgaaccttccgtatgtatattttatggcttttccgataggactgcctttcatcactttgggatattcattgaccagccatttctcgaagcgcacaagtatgggatatgcaagacgtgtcctaagttcagccctctgttcataggtcaggcgttcatcgtcagccttgcgctccacgtcataaagcagctgtatctgttcgagcgcatagtcggcacgctgcgtgtcattctttcttgcctcccaaaaatatctgcgcgcatgggcccagcagccaagaaggataatgcctttcttggcgtccagcatctcgtacctttcgtacccgtccgtctgtatggctccccggaacttgccgaagagtttcagcaccacctttccacttcgggaacccttgtcatagtaaaagaactgacgtccggtcatgacgctgcgcacaagccagatataacctttgaccgtcttgtgtctctcgtcattcatcacggggattgtcgtctcatccgactgtatgtagtcagtctgcatcaccagatcccataatcggaagtacaggggtcttagcagatccgccacatccttgaaccagtcgttgaccgttgacgcggggaggtgtacccccacacgcttgaactgttccagttgtctgtggaacggtatgtgatccacatatttccctatcatcatgtctgccagcaatgaggcggaggcatagctctttgctatcggcatgacgggaagcgggccggtcctgaactcgtccgtccccttccgtttggctgtatggcgcactatcctgcggatatagaacttctcgggctcgtgcataaggatctcggtcacttcctctccgggaaggagcgtccactcctccggattatacccttcgggatatatatgaacctcctcacgcgcaagattttccggaagggattttctcgtaggatgttgcctcctcgcttttttacgggcgatgatcgcttctctggtagccttcagctccttttccgcttcctctgcggcttcagcctcccggggaagcatgtcgaagccttcaaaatccagccagcggtcctgggcgtcagtcgacgagcctttggctgaagaagcccgtgcaattatcgcttcttgggattcggtgtcacttactactgaacagcaagaggctattaacgagtttcagactgtggtggataatccttatccgtgggagtatgttgaagagtaaagattactattaaacctgatttttttcatgcgcgaatttaatgaactaaaaattgccgtagccggaaccggttatgtagggatgagtattgccactttgctggcacagcatcacgaagtggtagcagtcgatgtactgcctgagaaagtagagaaaatcaatcagaagatttctcccattcaagatgattacatcgagcaatatatggccgagaaaccgttgcgtctctcagctactcttgatggaaccgcagcatactccaaggccgactttgtagttattgctgcccctaccaactacgattcggtaaagaactatttcgatactcaccacattgaggatgtcatcgaccttgtgctcagtgtcaatcccgatgccgtaatggtcatcaagtccaccatacctgtaggctactgtcgcagtctatacgttaagtatgcacagcgaggagccaagcagcttaacttgcttttctctcccgagtttcttcgagagagcaaggcactttacgataatctctatcccagccgcatcattgtgggggttcccaaaatgatgaatggtaatcagtttgatgcagaaaacgaagctatccggactatctctaatctaccgatgcttgagcaagctgctaaaacctttgctgccttattacaagaaggcgctataaaagcggatattccaactctctttatgggtattaaggaggctgaagctgtgaaactttttgctaacacatatttggcgctacgtgtcagttattttaatgaactcgatacttatgccgaagtaaaaggattggatgcacaatccatcatagaaggtgtaggacttgacccgcgcattggtactcactataacaaccccagcttcggttacggtggctactgtctgcccaaagatactaagcagttgcttgccaactatgccgatgtacctcagaacatgatgactgctattgtggagagtaaccgtacccgcaaagattttatcgccgaccaggtgttgcggaaagccggttactacactgcttccagtcaatgggatgcccagaaagaacaggatgtcgttgttggtgtcttccgccttaccatgaaatccaactctgataactttcgtcagtcatctatacaaggtattatgaagcgcatcaaggccaaaggtgcccaaattatcatctacgagcctgcgcttgaagatggtacttctttctttggtagtacggtagtaaacgatctagccaagttcaaacagatgagcgatgccgttattgctaatcgttacgatgcttgtttggatgatgtggcagataaagtattcactcgcgatattttctgcagagactagtaaatgtttaattttcacatcttcctgttcagattagttgtcatagtcatagctttgcatagctatcaaaataatgatagtatatagtagtggagatttagaaaatcgtatgctaatagttaaaaatccctttaaattttaattatgaaaggtattgtcttggccggtggttcgggcactcgcttatatccgatcaccattttgaatacaattgattatatttttctggactgataaagaccacactatattgttctggcatcaaaatttcttttattttccttgcaagttcttgatttttggaatcagaattgcttttactatcttgaactccaagttctattagctttttttctatattgttattgacaaaaacacctgctataaccaaaggcccaaaataatctcccttgcctgattcatctgttccaatatgactatcaaattttggaatatctttaattacaggtgattgaatattatctggctttatggaaggagtttttttttctctctgtgctaacatttctgcttcggtgtaaccattctctactaggattctataaccatccataatggatgatgagatttctccaattctattctccacttgctgtacatctgcaagattaataatttgtggattttgcgctgggtctgaatgtagttcatggcaacgcaaatcctcccacattacacgtaacttatcaacgatatttccatctctttttttgtcttttatatatttttcaaatttcttttctcgtaaagcatttccgattctagcgatttctgaattagactgatatttgtcatatgtaaaaaagcatttctctatcatcaatcggatgataaagccttcaaacacttttgcaaagggatacaggactggattatatagcggaattttcaagtcagtttgctttacagcttttaatataccgatggcgctaacgagtgtctgttgatcattattgaacagaaactcaaaagcatcttgagatatacggctttttgcttcgtcatataggtctacgaaaatattggggatagtatctattgctgcggcaacagctttttgctcgtttttaggtacatacattaatgcattttctttttcagtaattggattgattttttgaatgatagacaatacatctgaaaccaaggaagaatctactccctgtaacaatatcgttccattaacaaattgtgtaaccgttaaagcaacattgtttttttcaatacgtactttataaaagattgtctcttttggtttagtttcaaccacatcagaaaacatctctaaaatttttgcacgtattgtctcttgactttttgctgtcttgattttaaatgatgcatgaattggtacacttgggttataaagttgctcatcaacaaacacttcatctggtaaatcttttggtggtaaaaaccatgcaataatgtcatctgtcgttctttcaaaaaaaatttttgatgatgaagctcttttgaaatacaaaataatactaaattcttttccttgtgaaaaagtgaacttcaggccagacccattatttatttctttttcaatagcattgttaatgctattaagagcaagtatctctctaactttttctatcgcttgctctttagagtaaataaaatcaattgaacgtggcatataaaaacactcctttgtatgctcttgtttttacagcattttcaagaaaacaattcatgtggaaatttgcatttacctcagcaataccaatacacgttccttgctggggtctttgatgcccaactaactgcataaagtgccggcgacttgagctttttcatcaggttgtagatagaaactccataaaaaatcaaataaaatgaatataaaataaccagagtctgtgcaaaaactacttttagaggaatagtgatcttcttaagctcacacttttcctttatatcaattcaagcgtgtgtatttggattacatatttaaatcacaagataaagttcttttttctgcatttcatcttttatcaacaataaggacatatataatgatactaagggcaagaaagcctttagtcttcttttgagttcgtccatccccattatggtgatacagcgcgtcaggttatatatggtcataaagatgttaacctcactcaacacattggctttgcctttcattagagtatatgtaaatccccattggcgctttaaaatcccaaattgatgttctataatttgttgcctcaatttgtagtaattcctatttcctataaccctagcgttattttcatctattatatcttgatattcacttctttctattactctgccattttgattttgagtacatttttctcttattgagcaatttacacaggctgatgttttatatacttttgatctataattggggcggctcctccatttccctgttgttgtcatttgttctccacaagggcagatataataatctccgtcatttatataatgaaattcagctagtggtatggaattggaattaggcgatgttgatggcataggtgatgaataagtacatattcccgaatatttacaggcttgtagttggtcgccactagtataaccggcatcgctaagtgtgttgaacgaatctaattgtagtagttcctggacggtcaatgccgctgttgatagttctcttttatcagttgatgctccaatatgagagtgaaccaataatttgtgtttactatcagaggctgcttgaaccgcatatccaactcctgatacattattggttaacattaatgctcttgaatctttgtctgtcagacttacttgagtatcattactattcttcaattccgtatcaagagtttcgtatttcttacgccgatcttgttgtaatttaatcttagattcaagaagttctttttcttcctctttatcagtctcatctaaagctgcttcaaaatctttaatacgtttatctatatattcaagatgtctgtctatctttttttgtgtataattgtttctgagactattttgggcaaatatcttaaaagaatctatacctatggtttcgccttctatcagacccatatcctttaacataagaacaaactgcctaaagacttttctaaaagcctccgcattattttttctaaaataagcaattgtccgaaaagagggcattaagcctcctaatagccaccataattccacatttactttacaggagtgttccaactttcttgatgaccttattgagtgcttataaccatataaatacaattttagtaatgttacaggattatacggtggtctcccttctgattgaagtttgacatgtttaaacccaagctcatctataggcaagatatccacaaataaatcgataacccttgcccaagaatctggagcaaccaattgttcaagagctatcatttgaatttgatttctgttttctcctactatgtagttcatagatatattgtttagtttctttccataaatatacgaaaaataaatgataattcaatatagcgtctaaggtttttgcacagactctcgtctttctggtatttgtaagcatcccggtaagcttccaccgattttgtccccttgcttgccttgatggtatcggtcaggtcttcgatggaagtctgcagtttctcgttccggtccgtaagacggtctatagccgcctgcacttccctggcgttcccgccgatgccgaacagtttgttgaaacctccgaaagacactgtattcagcaatcccccgatacctttcacaagggaaccgcctatctgtttgaacaggtctccgctgaggatattgtcgagtattccggttatcgcattgaaaatggtgtctatcaatgatgagataatcgggccaataccgtctttcagcaaatccagtatggagagaatggccgatatgatctgcccgatgactccggcacttgacagggtctcggacatctgactgatggcatcaccgaccttgcctccgatattcagttttgaaagaccggtaagcatgttctggattccttcaaatgatccctgcaaggttccgctcgcaaagccgtgcaacccgtcggataccatgttcaacccgtcaaccgtgtcccgggaggcacttttcacctccccggcaagcgccttcatttcagaggtggcgttcaggtattcttcgtcagctgaaacgctggacgattgggccgtttgaagagcgattttggtacgttctatttctgcctggttaccgctttcaagagccttgttgtaatcggtctgcgccgcttttaaccgggcgaatgccgcttcctgctgcagttccgcattttgcacgcgtgttacggcatcccccaaagcgtgcatctgcgtttgcagccgggcaaaatccaatgtcccgttgccaccggggagcatgctttgaatacgttcaatggcatcgtaaacgacctgctggtctgcggctcccgtttttttgaactcatccgtcttgacatactgtttaagttcgccaagcaggttcttcatctggtctgcaagcagaccggtcaaatccccgaacgctgctccccagtctatcttctgggtaagggcttccatgtccactttgtgcacagccgcatcacgctgcttctccaaagtcagcctttctccctgggactgtgccttgcggattttctcggcatattcttcagcgatggccagtttctgctgctggaaagtaccgtattccttcagatagtcacgcatggcttccgcctcttccctgtacacgtccgtctccgcttttttccgggactcggtgtttgaggcacgggctttttcaagttcatcctgttgctcccgggtaagtccgttatctccggtggaaagaccggcttccttgttctcacgcttccagtcggcttcctgccggttaatttcttcttttctcgcgttatagtcatattcgatttgtgccagtttcttttcggtaccggcttgcatgcggtctatctcttccttccggttttcagcctgcaagacggcaagatcctgcgccagcctgcgctctgtggcaagccgttgcttggcttccgcttccggattcttcccggactggtgacacgccggcgtcggagttcgccttgacgccttccgagatacccttgacctgcgcgcctacgccggtctttaggtttgcacttacgctgtcgaaatatcctacgtccgccataatatattttattcccagaatttatcaaactggatataattaccgaaccaaaacttaaatgcttctcggtttataccatccgaaggtgtccaaaaatcaacaggatattcccagtctgaattgtgtgactttttaggagcaagccctaagtttacatactcatggaatggacttttgtgttgtgccgtctccaatattccgcaaaagcccaatgtttgtagaagacattgggtctgagttttatttgtatcaaataattgaatcttattaattcttttgacgatatccttttttaatgtttcttgagatgaggcatctacaaggctcatcataatttcattaaaaatatgagcatcagtacagcttggctctattgcattatttgccaatttattaaactcagtcagtagtacaatgcaaaattcaagactaaaagctggaattcctccagcattggaagctatctctaaataaaaattataatcttcattttcaaatccagcccatgaatctatattgcagattttacaaggatcatcacgaaatctattaacttcattagaactgacaaagtgatgtcttgggaatgtacgcgttattgcgaatgctggtaaaaaacttcgccataacatattaccagtagaaaggcttgacaaaaaaaatgaaactattttattttttttgttaatacatttatcatactggataaacagttcttcaatcattttgtcatgaaggcaagtatattgttgattcataaaatgtaatttttaaccgtaactattctttttagtagctctatattcctcaaatgttttcctttctccatttgcgatgcgatcagaaagagacatttttttaagttttttctctgcactacgcatgtacaatttgcccttctcactatttttatccctaattccgtttattttatttcctcggacattgtcacttcgatatcctaacaacgatactgaagaattatctataccaacttgttctattcctctcactatcaatctatctgtacctttttttgttatttgtacaatagtatcaccttcaccgaaccttggtccatcagttccctttgttcctgcatgccttcttgccacatcatttatgttagcattatctgatgctcttccagaataatacacctcacctttagaattaataagaacatagttccaatcaagtccatataaatctataatcaagttcgtgtcgctgacgtagccatacaggttgagtattccgccagccagtccaatcggatcttgcgagacatacatgcccatcttcggcgagtagtacctgaacctgttgtatgccagtcctgtctcacagtgggcatatccgggtccattatacctcctggcaaacccgacccagtctttctgctccagataggagtgtagcttagcaagtttcacaaacctcgcaaaagcttccagttgcttatcttctccgaaggtcatatctttcaccatttcctccacactgccatacccgcacatcgcatagttaaagcccatcacttggaacattccccatgaagtggaagcatcagcagcttctttatgtatttcccgggccttttccagacgttcatactctttcatcccgccataataatgccccttctcccatttaggataaagaatattttcattgcccgcaacatacctctccggatctagtccccgcttcttgagttcacgccaaaagatgtgaccttcgaataagatcatcggtcgccccggagccacaaagcccccacgaccaccggtctcaactgcctgtacagcttttaccactgctacctcaatgccaagtaaatccgccacacgctgaaaatcattttctgttaagtttcccatgagtaattagatttattttatttatatcgctctgatcgtatccaccactctcctgatatcctcatctgtcaatgtaggtcccgaaggcagacacaagccgatatcgaacaacctctcactcgtaccattcccatagaacggagcatccgtgaacacaggctgaagatgcatcggcttccacaaaggacgcgtctctatgttctcggagtccagcctcaaacggatatcctcacgactcttacccgcaagcttcggatcaaccagaatacaagtaagccaaaagttggaagcaaaccgcgaatcagggttctccatgaccgtaatgcccgccacatctttcagcaaatcaacatacaaagagtgaatggcacggcgacgggcaatatgttcatcgaggacaaacatctgcccacgaccgatacccgcacaaatattactcatccgatagttgtaaccgatatgggtatgctggtaatgcggagcggcatcacgagcctgcgtagcgtagaactttgtctgtcgggcctcctcttccgtacgacagatcagagcacctcccccggaagtcgtgatcatcttgttgccattgaaagagagagcggccagttcaccgaatgtgccacacttccgtccgttcagttccgaacccaaagcctccgcggcatcctccaatacggggataccataacgacccgcaatatccatgatctcgtccatcttggcaggcataccgtaaaggtggacagggataatagccttcgggagcttacccgtcttgcgcaaacggtcctttatagcctcctcgagcaataccggatccatattccaagtatccttctcactgtccacaaaaacaggtttggcctccagataagaaatcggattggcagaggcggcaaaagtaaaggatcaatgaataactctgaggggtgaaattataaattcttatctttgccttcaaatttatagaaaatggagttaaatggttatcgccttcttcttcctgaaggcaccttggattactttgctcttgttgatgtgaaggaaagcgtgaatgagattgtgatttaccttgaagagaagaatctggttcctgagcagtatgccggtgagggcactgagagcaaaggcttttatgatccagtggttgtccaggactttccccttcgtggcaagaaagtgtatctgaacattcgccgtcgtcgctggatattaaagaagagcaatgagtatatctgccgtaactggcgcatgttagctgagggtactcgtatgacgcaggattttgcgttttttttaaaagaactatattgataattatccgatcagctgcaagttattgggtactttatatggcgttgacggggatttatttgaacgtcaataccgtaaccatttaagtggctacctccactgggagcagcttgcccacgcagagaactggcttttgtttgaaaagaacattggtgcctacgtctgcattgatgaagtggctctctctcgtggagaactctatactgtgttgattaataaagaggctcacggtggtaaaggcagtattatcgctatcattaaaggtacggctgtttgtacagtcacctctgtcctgcttaaactttcccgtcgtcgtcgctaccaggtacgtgagataacattggatatggcccccaatatggcacagattgcccggacttgcttccctgccgccaaacgcgttacagatcgtttccatgtaccgaaattagcctatgaagctgttcaggagatgcgcgtgaaagctcgctgggaggctttggacgaagagtccatacagattgcttacgcaaaggcctgcggaaagatgtatcatgcgcccgttttcgctaatggagatacaagaaaacagttgctggcaaggagtatttatctgctttacaaaaaagaatcgctatggactcagtcacaaaggatacgggccgagattctatttaaagaatatcccgatataaagaagggatattatctggccatgcggttaggctcaatctatcatcagtgtaagtttaaagatattgctttgacaaggcttgcaaggtggtatgatgaagtagacaaatcggagttcctcacctttggaagggtagcgcgctctatacaaacgcactatctgaatataataaacttctttgaaagaagggctaccaatgcagcagcagaatcatttaatgctaaaatcaaagcgtttagggcacagttcagaggagtaagagataaagcatttttcttgtacagactcgccaaattatatgcataaaaagaaaagccctcagatttttacattgatccagaatcacacgatctgccggaatacgccagtcaatacccaaatccggatcatcccaggcaatggcaccctcactatgcggagcataaaaattatcacacttatactgaaaaacaactgcctcactcaatacactgaatccatgtgccaacccacggggaatgaaaaattgacgatgattatcctccgtcaactctactgccacatgttgtccaaatgtaggagatcctttacggatatcaacagctacatccaataccgctcctttcactacacgcaccaatttactctgagcaaaaggggcctgttgaaaatgtaaaccacgaagtacaccataactcgatttactttcattatcctggacaaacgtagtcttgcatactttttcctcaaactccctctgattaaaagattcaaagaaatatccccggtcatctttaaaaatacggggctcaaggataacaaccccatcgatagcagtctttattacattcatttcaaaccaagttcctgtatcactttcaacaaatactgtccgtactggttcttcagcatcggctttgccaattcacgcatcttatcggcactgatccaaccttgcctcaaagcaattccttccaaacaagctactttcaatccctgacgcttttctatcacttcaataaaagtagatgcttcacttaaagaatcatgcgtaccggtatccaaccaggcaaaaccacgacctaacaactgaactttcagttcctgatctttgagaaattcctgattcactgtcgttatctccaattctccgcgtgcagagggctctattttttttgctacttccaccaccttattcggatagaaataaagccctaccactgcataattagacttcggttcttcaggcttctcttccagactcaagacgtttccttctttgtcaaattcagccactccataacgttccggatcacttacccaataaccgaacaccgttgccttctgttccacttctgccatgcgtacagcttcattcagcatacgggtaaaactctgcccatagaagatattatctccaagcaccaaacaaaccgaatcactcccaatgaattcctcaccgataatgaatgcttgagccaaaccatccggagaaggttgttccgcatactctaaacgtattccgtaatcagaaccatctcccagtaaacgtcggaaagcaggaagatcatccggagtagatataatcaagatttcacggataccggcaagcatcaacaccgaaaccggataataaatcatcggtttatcaaaaataggaagaagctgtttactaactcctttggtgatggggtacagacgagtaccggaaccaccggctaaaacaatgcctttcataaatctgtttgcttttaaattcagcacaaagatagctatatttcaataaaatacaaacattttgtacacaaacgtgtacacgccataaaaacccgtttccaatcctaccgcccgttggttggttttgctttgctctttttccctatcgtttttctttttccgacagtaaatcaaccacttagctctataaattccccttgtctgttataagcatcgtctgtaatatgctctatcacttcttcgcaaacgcccataaataaagggattagaacatgtgtttccccacactttgggagtttagtccccacactttgggagtttaaaagtaaattagtccccacactttgggagttttacccctctttttttgttttaatgtggggattgtgtatatttgcagcaaatcaatcgtttatgaaaaagaaactacctattaccaagaataaagatgttgttgtttcatgggtatatacatggtcaaaacagcaagacatgtccatacacgaacaaagaatagttcttcgcatactggaagcgtgccaagctgaactaaagggagtaaaactgaaagattatgcaggcacgaaacgcaagtttgagcatggactttgggatgttgatgcacaaatgcatgtatctgacgttattttttccggacgtgattacaatgaaatcatagccgcactcgattctttggcaggacgtttttttacttacgaagatgacgaggaatggtggaagtgcggatttatatctaacccaaaatataaaaaacgcactggcattataacctttcgtgtgtctaacgacctttgggatgtgtttaccaagttcgccaaggggtacagagaatttgagttaaacaaggctcttgcgctacctactgggtattcccttaggttttacatgttaatgagtgggcaggtgtaccctttggatatatcccttgaaaacttgaaagaccgtcttggcatacctgcggacaaatacaaggacaagaacggaaaagacagaatagatcattttgaggaaagagttttgaaaccagcaaaggctgcgcttgatgagagctgcccatacactttcaactacgtgaaagtgcgtgaaaacccaaacaacaaacgtagcaaggtgaccgggtttaggttctacccggtctatcaaccacagttcagagatgaagaactggaagggaaagaattgcaagcaaaggttacagcacgatatcagatagacagccatgtgtacgagtacctccgttattcctgcggcttcacatcggaagagataaaccggaacaaagagacattcataacggcacaagaaatctgtttgcttttaaattcagcacaaagatagctatatttcaataaaatacaaactttttgtacacaaatgtgtacacgccataaaaagcagctcacagtcctaccgcccgttggttggttttgctttgctctttttccctattgtttttctttttccgacagtaaatcagccatttaactctataaatttcccttgtctgttataagcatcgtctgtaatatgctctatcacttcttcgcaaatacccatgaataaagggattaaagcatgagtttccctacattttgggagttttaatcctacactttgggagtttttcacctcactattccctacactttgggagttttacccttctttttttgtttcaatgtaggttttatgtatatttgcagcaaatcaatcgcttatgaaaaagaaactacctattaccaaaaacaaagatgttgttgtttcatgggtatatacatggtctaaacagcaagatatgtccatacacgaacaaagaatagtacttcgtatcttggaagcatgccaggcagaattgaaaggggtaaagctgaaagattatgcaggtacgaaacgcaaatttgagcatggactttgggatgttgatgcacaaatgcatgtctcggacgttattttttccggacgtgattacaatgaaatcatagccgcactcgattctttggcaggacgttttttcacttacgaagatgacgaggagtggtggaagtgcggatttatatctaatcccaaatataaaaaacacactggcattataacctttcgtgtgtctaatgacctttgggatgtgtttaccaagttcgccaaggggtacagagagtttgaattaaacaaggctcttgcgctgcctaccgggtattcccttaggttttacatgctaatgagtgggcaagtgtaccctttggatatatcccttgacaacttgaaagaccgccttggcataccagcggacaagtacaaggacaagaacggaaaagatagaattgacaacttcgaggaaagggttttaaaacctgcaaaggctgcgcttgatgagagttgcccatacactttcaactacgtgaaagtgcgtgaaaacccaaacaacaaacgtagcaaggtgaccggatttaggttttacccggtctatcagccacagttcagggatgaagaactggaagggaaagaattgcaggcaaaggttacagcacgatatcagatagacagccatgtatacgagtatctccgttattcctgcggtttcacatcggaagagataaaccggaacaaagagacattcataacggcacaagaaaaccacttttattatgcgtaagtttgtgtattacaatcagatataacggtcttggacacacaatggtgtttcaaaaaacgtacgttttttgaaacaccattgttactctccgcactaaatgcaaggaggatagataaatgactgataattaaaacgatgtagaaagatttgcacagatgaaaaaagcaacctatctttgttgcatcagacgtacgtcttttgaaacaccatttgaaaaactaaatctgtattttataagtctaatttccagtttatctccactacattacagaacttatctatagcacgaaacaaactggcactagtcaaatattcattcaatgtcagattctttgctatagacaaaacgctttctgtccatagcaaagaatcttgtttctcatttcgttcaacatgtatggaggtgccaagttatcagcacttttataatctcgttatcatgccttttataattgcatgtgacacaacattgtcctcatgctaacctttgaatcaagtttgtttaataggttagttcaaaagtgaatattattgtttggtgccttttacacaacggacaaaataaccattagttaggagagaccaccaagcaccagtattactgaccactacagttattgttgtaaattccataacataacaattacttccactgctccctagtgttgaagtcacgtaacacccatgatctgtatatcccgctccacctgtacccgctccactttcctgtcgcattcctccagcttttaaaaataaccccagactttgatgtgtaaaccacatacctccattagtataaactttatctgtacatcgtgccagtttttccagttcatttttagttggtgttcgccagcttgtgccataatatgcagtattcaatttagaacacggatctccggtactgccatcataaagtttattgaaggcatagtaatatccggtttctgtctgcgaaggtgcccacacgtaattggcgtttcccatactttttaaatttcccgtgccccatctcagctttgccaaatcattcttatcatttgtggtacatccgttttgtgtcaggttaatgttacttgccgccaattgtactcccaattcaaactttagcgtaatggtataactctttcctggtagcaactgtacattctggctcgaggtgatattccggttatccgcgttaaagtaattactaagtttcaacgtaccgatatgtaccgtgattgcccgggaacccgaaaaagggactaaccgtacagtggcagtagaattattgccaatattgaatgtaggtgtatttcgtgacacgccggcgtcggagttcgccttgacgccttccgagatacccttgacctgcgcgcctacgccggtctttaggttagcactcacgctgtcgaaataacctgtgtccgccataactatgtgcttgcattaagctgttaccattcggaacatctaaatttatcaaaagtctttaaattcatcgttttccataaaaaagattaaggcttctatataatctttttctgatggtatgccaatttgatccattacatttaataatatatcttcaaattgttcgccataatacaataattccaaattttctttctgtacaaaatcgggataaacttcttcatcatttttaatttcaggatatttatcaatgaagcatagttgatcccactgtatattttcacttttagaatatatacaataattctcatttgagaatccatgtacctgtatctgctgggatacttgtttgattataaaacctaaagtataaggcttttctgattttaaattatccatatatttattattttttttgtttataacctgtggaaccatttaatcgtcctttacgaccatcattaccaccaccccataaatctcgcccacctttacctgatggatgataaagtttatgattgagtgaatgatctcttctgtccaccaagaccagtctccttgtttcttcatgatgatgccatgtaaaaccagacgggcttgatgtcatgtttggatttttaatccatgcatgtagttctggatgcctttttaacatatcatgcttaaagattgcatcagaattgattttatttagaaattcttgatttgctctattaaattggacagcatcacttgcgtattggtctttcgcattcactgtatgctcaaaaaagatgtgatactttccattattggggcgtgtagctaaaccaagaacatcactccacgcatttgtatcatcgacatacccatataaattgagtattccaccaccaagtccaatcgggtcttgcgagacgtacatccccatcttcgggtcatagtacctgaacctgttatatgccagccctgtctcccgatcataatactgtccctggaacaggaacggtaccattcccttgttgcccgtttcctcgatgacgttcccgtccatgtcgagtacccggctccacacctcgttgccctcggcatcgtatgcctccgtcggtgttccgagctggtcggtcagtatcgagtaggacctgccctccctgagcattgccatcggtacgaacgactcctcgtcgaagagccataccgtcatgtcgcggcgttccgtgagcgtgattggaagtaccccgtactggaggccgagcagttcacggcgtggaactttacctatgccggctatgagcgggatgcgtacacggcccgtgtgaaagtaaccgaccggggcagtgtggtgaaggaagacctgctgcagcgcggtgagaccggcaactacgggcggacgaacgtgaacgtggaaccgctggattaccgtgtgtcgtgcggtgatgccgtgcttgaggtgcaggtgaacaccacatcgcaccccgacattgaagccacgctggcaccggatgccgtgtgtacgttcgatgccttcgggcgaagcaacacggaaaacaacccggcaagctgggtgagcggagacaagcgcatggagttccgggacgtgctgtggagcgtgaacgaatacggcgcaggaagcggctggcacaaggaccgcctgctgctggccggcggtgcgggcatgaccctgacggcagacggcggttatcgcccgttcaacgaggcggacaagcccgaggggtttgccatccgcgacgtgggcatgacactggagatagaatacagcacggccaacgtgacggacacgaatgcggagctgatcacctgccttggacagctggataacggcaaccgttacgggctggtggtgaccccggaggaggccaagttccttaccggcgtggtgacggaggcgatggatgccggacaggtgctgcgctacgaggactcggtgggtacgaagttccagccgggaacgaatatccgcattacctatgtgttctacccgaacgtgcagacgaacgagcagcggacgctgatcggcttctatgtgaacggggaggagtcggccgcgtcgaagtggttggacaaggtgaactttgacatccgtagccagcttgaattcaagtcggtgggcgcggacttgttcgtgaagagcgtgcgtatctatgacaaggcgctgacatctgacgaggtgcttaacaactacatcgtggaccgtaaccatctggaggatgccgacggggagccgggcgtgcgctcgctcgacgaggacaaccgcgtgctcagcgagggggacacggtgagcatggagaagctgatggggctgatgaagaagcggcggaactcgatcctggtactgataggcacgggcagcgtgggcagtgaggtgccgagcgggagcgacacgctgaacgtgatggatgcgctggcccagctgaacaacaagaaggccaacaagctgtgccgggaagtgagattctacaacggcgagaaccgggcgctggactggatagatcggcgaggctgtgctcaccgcggcatggacgcgtccgcctttaatcggtggagaacgtgccaaatacccaagataaaatattgatttggagggagtaattatgaatctggaaaaattagctgctgtcgatcctgaaattaatgctgctatttgcgaggagcttggcaggcaaagaaataaaatagaattgatcgcatccgaaaactttgtttctcctgcagtaatggaggcgatgggtactgttctgactaataaatatgctgaggggtatcccggacatcggtattatggcggctgtgaatatgtcgacaaagtggaaatactggctatagaacgtgcaaagaaactattcggtgctgatcatgtcaacgtacagccacattctggcgctaatgcaaatactgctgtttattttgcctttctgaagccaggtgatactatcatgggaatgaatctgtctcagggtggacatttatcacatggatcgccagtaaatatttccggcagttattataacgtagttccttatggtgttgatcatgatactgagactattgattacgatgctttggcacaaactgctgctgaaacaaaacctaaaattatcgttgctggtgccagcgcctattcccgaatcatagattttaaacgtatgtcagagatagcgcatagtgtcggtgctttactgatggttgatattgcgcatattgccggacttgtagccgctggtttacatcccagccctgttccttacgcggatatcgttacgacaactacacacaaaacactgcgcggtccgcgcggcggcctgattatgtgtaaggaacagtatgctaaagctattgataaggcaatattccctggtattcagggtggtcctttgatgcatattattgctgccaaggcagttgcttttggtgaagctttaaaacctgaatttaaagtatatcagcagaatattcttgataattgcagagtattcgcggaagctttgcaggaagaaggcttccgtattgtttcaggaggtactgataatcatctgattctggttgatgtacgcggtcagaagctgactggtaagatagcagaacatttattagatgaggttggtgtaacctgcaataagaatacgattccgtttgatcctgaaagtccttttgttacaagtggtatcaggttgggtactgctgccgtcactacacgcggttttaaacaggaggatatgcgtgaggtcgccgcaatcattggtttagttttgaataatttaggatggaataatttatctatatttagattcaatttagagattgatggtaaataacataataaaaccctaggttgtactttcgttatatccaagtttatattgagaatataatcaaactgacttctacgtaaaattcgatattttaaatgattcaatattttatatatcataatactactaaataaaattactcaccaacatctatactaggagaacattctttttttaaacataggaaaacagcataccaaagtaaataaaaacgaagagtaaataaaaaagtaccatttggtattaactcacataaaaatactaaaagaaaaaaagcagcccctttttgtgcataagagcctttttggaaaaaagctctatatatagcaacaaaacaaatagataccagaagaaataaataacaaatccctccctttaatattaaatctaaatatcctgtttcaataccatttctataggaactcaaaccgttttcactttctcccaaagcagtataaggagtctcaaaagttccaccaatccctcttcccaatatataatcgaatccagaaaaatcttcataaaattcctctacaattccagaacgagagtctctattcatcctactcttcaacatttcaaaaactacagaatcagaattttcaaataaatatatcagtcctattccactaaaaagcaaaattcctccaaacaaaaattttaaaaatttggatttataaatcagtatacaattataatagaaagaaaagaaaagtgataagataatcacaaaaatcatacttctacgccctaatattaatgcaaaatataatcccaaaataacggctagtatagatatcagtcgctgagccacagtatttaacttaaataaaataacagcaaacaatgcactataaaccatagatttaccagaatactcaataaagctaacacaagagatgtagtctacaatattaaaaatattcaacaaataataaaaactaattagtatatacacaatattacacacaaacagtatttttaaaatttgtttaatatctatagtgtttttcttattaaaaaggaaaataagactaaaaggtaaaaacaaataaggataaaataatatttcaaataattcctgcgctctgtggcaagccgttgcttggcttccgcttcctgattcttcccggactgttcggggtcggtatgtccgccgatatttccttttttggctgcttctgccgctttctttacctcttcctccgcttttttcagataaccgtcgcgtttgttttcggcatttttcaacagtatgtcataagcttcctgatcatgtttcttaatggcagcctgtgcgtcatagaactgcccggattctgccatgcttgactgcatgatatattgtccccatttcccgaaaaaacccatggcgctttccgcctcttccggtttctgcgccttgattttattcacctcttcatcggcttctgcagctttttttacaaggttctggacattggcctggtgcagcaggacctgtacatagtcctcgctcttttggataagggtatcataccattcggaaagtgttttataatacccgaaagattccccgtacttgcggttcagttcctctaccttcgccttttcctgttccttgctgccggtgaagttctttatttcatcgatgaccgatttcagttcgaagcgggtacgcaccatctgggcacggccgtccttctctatctcggtcatttccttgagtgatatgttgaattcatccacgccttttttggcactgaacaggtttttcgtccaatcccagatttcatcaccgtacattaccagcagcatgatgccggtggtcatggccgtctgccaggaaaagagcgaggacaggacctgtttccataccggtgtgcctttcttgcctgacttctgcagctcatcatattccttacgggcacgggccagttcgtccgtaaaaatcggcaggttgttggatatggccagaaagaacatctgcggtcccatggccaaagaaggcatttcacgggccatctgctggatgctgttgtgaagcccgttgaactggcgctgtgcattgggcatgtctgcaggggtgacctgcacggattccgattcctcctgcagcagtttcagtttgccacgcaattcctcaagctgcttctccagtgcatggatctgcgcgatattggcactctggtccggacaattcttgcttttctcgctttgctcaaaaagattttaagattacctttgtggcatggaactaagacggaacgaaaagattacattccggtgtaccgaacttgaaaaggacgcacttgcggagcaggcagcccggtgcagtctaagcgtatcggaatactgccggagtttgtcccttggggggcgcccaagggagaggtacaccgaggaggaacggcagcttctccgggacatagcccagttgaaaggaacgctccaacggctgaacaactacttcggtggtcgccagtaccgggaagtgttcgaggagaaccgggcactaattacagagctcaaaaaaatactctcacgatgatagggaaagggaaaagcatatcacatggtgtggcggcattggagtacgacctcgccaaagagataaacgggcaggcagtagccaccgagatagcccggcatgaactttatgggtgtactggtgcggaaatggtgcaggaaatgaaaccgtatcacattgattttccgaacgtaaaaaacaactgcctacgtttcgaggtcagcccctcgatagaggaaagcgccacctttacggatgcggactgggcggaacttggtaacgacttcatgcagcgcatggggttggcgaaccaccagtacatcatcatccggcacagcggtacggagagcaagaaagagcaagcccacctgcacatactggcaaaccgggtttccctttccggggaactgtaccgggacaactggatagggaaaaaggcaacggaagccgccaatgccatagccaaggaacggaactttgtacagtcgcaggacattggcaaagtcaacaaagcggaaatcaaggaagccatggacggcgtattgaagaagatgcagggctttgactttaccaaattcaaggaagaacttggtaagagaggttttaaagtccgggaagccagggcaagcaccgggaaacttaacggctactatgtcacagcccgaagcggtacggagtataaggcaagcgagatagggaaaggctacactctcgcccatatcgagcggacacaaagcaaacggatcagagtgccaatatcgcgcagatccatgcactggagaagcagcttgaggaattgcgaagccagttgaaactgctgcaggaggaatcggaatccgtgcaggttacccctgcagatgtacccaacgcacagcgccagttcaatggtctgcacaacagtatccagcagatagcccgtgagatgccttcactggccatgggaccgcagatgttcttcctggccatatccaacaacctgccgatttttacggacgaactggcccgtgcccgcaaggaatacgatgagctgcagaagtccggtaagaaaggtacaccggtatggaagcaggttctgtcctcactcttttcctggcagacagccatgaccaccggtatcatgctgctggtgatgtacggtgacgaaatatgggattggacgaaaaaactgttcagtgccaagaaaggcgtagacgagtttaacatctcgctgaaggaaatgaccgagatagagaaagacggccgtgcccagatggtgcgtacccgtttcgaacttaaatcggttatcgatgagataaagaacttcgtcggaagcaaggaacaggaaaaggcgaaggtggaggaactgaaccgcaagtacggggaatctttcggatattataaaacactttctgaatggtatgataccattatccaaaagagtgatgattatgtacaatccctcttcctccaagcgaaagtacagaatttagtaaaaaaagcgtcagaggttgatgaaaaaatagccgaggcagaggctaaggacgagagtgaatttgatacttggtggggatatggaggaaaggttgaccgtttcttttcttcggatcaatcatataaacagaataataacggacgttggaaaaaaaaggaagaaatagagcggcttaaatcagaatataacggatatatattagcagcggagaatttaaccaaggaacgcttgaaactggaacagaagtcaggcatcggcgggcataccgaccccaaacagcccggaaagaatccggaagcggaagccaagcaacggcttgccacagagcgcaactaaccgtacagtggcagtagaattattgccaatattgaatgtaggtgtatttccggtattggcacttacattatttgtagagggacctatcgtccaggcggacgcattaccgccctgagaaacatatacgcccgtacagttggtaaacgtgttgcttccaaactgtgacaaggagagcttaaccgtcagcttgcagagtttttgcgtgaaactaaccgacaggttgtggttgattgtactcacatttgccatatcccccgaatcataaaccataaagtcattactcatattcgggatagtgacggaagtaccgttataagcataggctgaaggaatcgttcccatcgctgtcgtactattgaacgagtatccgatcacacggacagttcccgctctggtgagtaactttccttgcctgagtgtgggagcggaagccccgttcgtcgtaaaatccgctgccgactggaacacgtaattgctgcccaccttacggaaagcgatcaaccggaaataaatgccattacccaatgtagcggcacgggtagtgacttgcggctcttcgcggagtgtcatccggaccgctgaaggaccctcgtaaggtacggcagcgggtatggccctgctggcgggtgattccttaaccggtacccattcgtctacaagagttcttcccccggttgtggcgggagtatcaacatgactttccatatagctgccatcctcaacccggctgaccgtaatagggatcacatcccctccgtccggttcggggctgtcagggtttacaacattgtctccacacgatgttatcattaaaaaagccgcgcacacacagcatgtgcttaacgcacgaaagcctacatacagaagttttgcctttgtattcataattcaaatgtttaaaagtgaataaaatagatcatgctcagcatggccttcccattaagaatggacaggccggctatagcaggctgtgaatacagcttttattttgcggtaagtttgtgtaagttagatagatagaacggctcttgtgtttcaaaagacgttcgtacccgttggcggaattaacttagtgcgtatttaattctgccaataggcttgttattaatatagttgacgaattgcaacacggtcagcgcactaattttgccaatgattctggcaaacaaaccgtttgttatcttagcatagttcctgatgaccaggaactggcctgacaattgagaaaatatcgtttcaatcctcttgcgtgcttttgcaaagggaatgaaagtcggtttccaatccttttggttcagccggtaggggcattccaaccggatatgtgcggtttcaaagaggtcaagctgtacgtcagccccgatatagcctttgtctccatagatgctgcaatcatgatattccagtttcacgtctttcatgtaattgaggtcatgtacactcgcctttgacaagtcataggaatgaattactccacttaacccgcagattgcatgaagcttataaccaaagtaatatgtgttttgcgaagcgcaatagccaaagtcaggcgcttttgaaaaatctcccgactgtcccatcttgcagcgttttccccttgcgggacgacagacttctatcggtttggaatcaacaaggaagaaatcctcaccgccgtcaattttcagggcaatccgcttgcgtatggtttcacacaaccctgccgttttcttcctacggtcattgaattgtctgcgtgatataagatttggaattttttccttgtattcttgcagtttgtactcaaaaagccaattctcactgtctatgctttctgattctgccgctaacgacaacgccacgacctccaggtctgaaaatctaggaacagggccacggcggacaatatttccttcggcattgacgagattatgagaaaattgcttgcatatctcaagtattctgacgaattttgtgtgtaagttgtgcatgcgatgatttaaacttaatgatttggacagcactaagttaataaaaatcagcgatatgcgcaactttccaaacatattatcaactcaaattaattccgccaacaggtccgcaaaacgaaacgtttacgcaggtttaatttctgtttacgtggagggctgttttggttgcatcggtttggcgattgctttaaatgggcttacatgaagtttacatggtgtgtaagcaggagaggaagatagcggttgtggccgctttttttatgccttgttttggattatatgtttctaaaatattccatataatgattatttagtatatttgtactataaaatatagtgatatggcaaaggttgtacatgtgcatttgacgcacggaatagacggaacaaagcgaagagattggtattttagtagtatttcggctgtttatacggttttgacggcggaacaggtgggtgcgaccaagaattatttgttacatgccggtctgtccggtaatggtacagtatgcactaaaagggctataatcaagcaatctacgcttatttcagggagtaggaggggagagtaggtgaatagattagaatggcattagaacgaaagaaaatcaccattcagcagttattcttgtgggggagacttatggtctcctttttttgtgctctcagatggcgatttctacatttggtgtgacacttggagtggcaattttggaggtggggatagtactggggttagaaagtggggttagtttttataagaactggggttagtaaacatggttttgagagggggtagttggaagtatggtaaaatatggttttttgaatgataggtgtaaaatatgccttgatacacccaccctaaaaaccaccacctataaaaagcatacattattatataacggattatcagtccttttcaggcgattatatggggtggatggagggggaataccgagagaggggagtctgaaggtataatcgggggtatcctcagggtaacgtttcatgttctccggatggtaaaagtgcgctctaccctacatttgcatctccagaagtgtacgcatccgatgcaggtttccctttttcaagattcatttggcgaatttgttctttgagacggcc
